US011723932B2

(12) United States Patent
Falb et al.

(10) Patent No.: US 11,723,932 B2
(45) Date of Patent: Aug. 15, 2023

(54) MICROORGANISMS PROGRAMMED TO PRODUCE IMMUNE MODULATORS AND ANTI-CANCER THERAPEUTICS IN TUMOR CELLS

(71) Applicant: Synlogic Operating Company, Inc., Cambridge, MA (US)

(72) Inventors: Dean Falb, Sherborn, MA (US); Jonathan W. Kotula, Somerville, MA (US); Vincent M. Isabella, Cambridge, MA (US); Paul F. Miller, Salem, CT (US); Suman Machinani, Cambridge, MA (US); Saurabh Saha, Wellesley Hills, MA (US); Adam B. Fisher, Cambridge, MA (US); Yves Millet, Newton, MA (US); Ning Li, Winchester, MA (US)

(73) Assignee: Synlogic Operating Company, Inc., Cambridge, MA (US)

( * ) Notice: Subject to any disclaimer, the term of this patent is extended or adjusted under 35 U.S.C. 154(b) by 1327 days.

(21) Appl. No.: 16/069,220

(22) PCT Filed: Jan. 11, 2017

(86) PCT No.: PCT/US2017/013072
§ 371 (c)(1),
(2) Date: Jul. 11, 2018

(87) PCT Pub. No.: WO2017/123675
PCT Pub. Date: Jul. 20, 2017

(65) Prior Publication Data
US 2019/0160115 A1 May 30, 2019

Related U.S. Application Data

(63) Continuation-in-part of application No. 15/164,828, filed on May 25, 2016, now Pat. No. 9,688,967, and a continuation-in-part of application No. PCT/US2016/034200, filed on May 25, 2016, and a
(Continued)

(51) Int. Cl.
| | |
|---|---|
| A01N 63/00 | (2020.01) |
| A61K 35/74 | (2015.01) |
| C07K 16/28 | (2006.01) |
| A61P 35/00 | (2006.01) |
| C07K 14/54 | (2006.01) |
| C12N 15/70 | (2006.01) |
| C12P 13/22 | (2006.01) |
| A61K 38/20 | (2006.01) |
| C12N 15/00 | (2006.01) |
| C12N 5/00 | (2006.01) |
| C07K 14/34 | (2006.01) |
| A61K 31/00 | (2006.01) |
| C07K 14/335 | (2006.01) |
| C07K 14/245 | (2006.01) |
| A61K 39/395 | (2006.01) |
| C07K 14/535 | (2006.01) |
| C07K 14/55 | (2006.01) |
| A61K 48/00 | (2006.01) |
| A61K 38/19 | (2006.01) |

(Continued)

(52) U.S. Cl.
CPC .............. *A61K 35/74* (2013.01); *A61K 31/00* (2013.01); *A61K 38/193* (2013.01); *A61K 38/20* (2013.01); *A61K 39/3955* (2013.01); *A61K 39/39541* (2013.01); *A61K 48/00* (2013.01); *A61P 35/00* (2018.01); *C07K 14/245* (2013.01); *C07K 14/335* (2013.01); *C07K 14/34* (2013.01); *C07K 14/535* (2013.01); *C07K 14/54* (2013.01); *C07K 14/5434* (2013.01); *C07K 14/5443* (2013.01); *C07K 14/55* (2013.01); *C07K 16/2803* (2013.01); *C07K 16/2818* (2013.01); *C07K 16/2827* (2013.01); *C12N 5/00* (2013.01); *C12N 15/00* (2013.01); *C12N 15/70* (2013.01); *C12P 13/227* (2013.01); *C12P 21/02* (2013.01); *A61K 2039/505* (2013.01); *C07K 2317/622* (2013.01); *C07K 2317/76* (2013.01); *C07K 2319/03* (2013.01); *C07K 2319/036* (2013.01); *C07K 2319/40* (2013.01)

(58) Field of Classification Search
None
See application file for complete search history.

(56) References Cited

U.S. PATENT DOCUMENTS

| | | | |
|---|---|---|---|
| 8,716,301 B2 | 5/2014 | Sitkovsky et al. | |
| 9,975,959 B2 * | 5/2018 | Georgiou | ........... C07K 16/2896 |
| 2004/0229338 A1 | 11/2004 | King | |

(Continued)

FOREIGN PATENT DOCUMENTS

| | | |
|---|---|---|
| CN | 104471057 A | 3/2015 |
| CN | 104946705 A | 9/2015 |

(Continued)

OTHER PUBLICATIONS

U.S. Appl. No. 16/474,383, filed Jun. 27, 2019, 2019-0336544, Allowed.
(Continued)

Primary Examiner — Michael D Burkhart
(74) Attorney, Agent, or Firm — McCarter & English, LLP; Marcie B. Clarke

(57) ABSTRACT

Genetically programmed microorganisms, such as bacteria or virus, pharmaceutical compositions thereof, and methods of modulating and treating cancers are disclosed.

7 Claims, 133 Drawing Sheets

Specification includes a Sequence Listing.

Related U.S. Application Data continuation-in-part of application No. PCT/US2016/032565, filed on May 13, 2016.

(60) Provisional application No. 62/443,639, filed on Jan. 6, 2017, provisional application No. 62/439,871, filed on Dec. 28, 2016, provisional application No. 62/423,170, filed on Nov. 16, 2016, provisional application No. 62/385,235, filed on Sep. 8, 2016, provisional application No. 62/362,954, filed on Jul. 15, 2016, provisional application No. 62/354,682, filed on Jun. 24, 2016, provisional application No. 62/348,360, filed on Jun. 10, 2016, provisional application No. 62/348,699, filed on Jun. 10, 2016, provisional application No. 62/347,567, filed on Jun. 8, 2016, provisional application No. 62/347,508, filed on Jun. 8, 2016, provisional application No. 62/335,940, filed on May 13, 2016, provisional application No. 62/314,322, filed on Mar. 28, 2016, provisional application No. 62/313,691, filed on Mar. 25, 2016, provisional application No. 62/305,462, filed on Mar. 8, 2016, provisional application No. 62/297,778, filed on Feb. 19, 2016, provisional application No. 62/293,749, filed on Feb. 10, 2016, provisional application No. 62/277,455, filed on Jan. 11, 2016, provisional application No. 62/277,450, filed on Jan. 11, 2016.

(51) Int. Cl.
    *C12P 21/02*     (2006.01)
    *A61K 39/00*     (2006.01)

(56) References Cited

U.S. PATENT DOCUMENTS

| | | |
|---|---|---|
| 2005/0220799 A1 | 10/2005 | Sitkovsky et al. |
| 2010/0255036 A1 | 10/2010 | Hassan et al. |
| 2013/0295054 A1 | 11/2013 | Huang et al. |
| 2014/0093885 A1 | 4/2014 | Hua et al. |
| 2014/0178341 A1 | 6/2014 | Zhao et al. |
| 2015/0368654 A1 | 12/2015 | Afriat Herskovits et al. |
| 2016/0058845 A1 | 3/2016 | Georgiou et al. |
| 2018/0028577 A1 | 2/2018 | Bishai et al. |
| 2019/0336544 A1 | 11/2019 | Falb et al. |
| 2020/0071702 A1 | 3/2020 | Thanos et al. |
| 2020/0149053 A1 | 5/2020 | Fisher et al. |
| 2020/0215123 A1 | 7/2020 | Thanos et al. |
| 2022/0023358 A1 | 1/2022 | Lora et al. |

FOREIGN PATENT DOCUMENTS

| | | |
|---|---|---|
| CN | 106539814 A | 3/2017 |
| CN | 107847534 A | 3/2018 |
| EP | 3141602 A1 | 3/2017 |
| EP | 3559022 A2 | 10/2019 |
| JP | 5-502881 A | 5/1993 |
| JP | 2004-500042 A | 1/2004 |
| JP | 2005-516917 A | 6/2005 |
| JP | 2016-533753 A | 11/2016 |
| JP | 2016-538344 A | 12/2016 |
| WO | 1991/09524 A1 | 7/1991 |
| WO | 2001/025397 A2 | 4/2001 |
| WO | 2003/050241 A2 | 6/2003 |
| WO | 2007/123737 A2 | 11/2007 |
| WO | 2008/073148 A2 | 6/2008 |
| WO | 2014/198002 A1 | 12/2014 |
| WO | 2015/031771 A2 | 3/2015 |
| WO | 2015/077354 A1 | 5/2015 |
| WO | 2015/078840 A1 | 6/2015 |
| WO | 2015/166640 A1 | 11/2015 |
| WO | 2016/033488 A1 | 3/2016 |
| WO | 2016/090343 A1 | 6/2016 |
| WO | 2016/106178 A1 | 6/2016 |
| WO | 2016/130616 A1 | 8/2016 |
| WO | 2016/183532 A1 | 11/2016 |
| WO | 2016/191283 A2 | 12/2016 |
| WO | 2016/210373 A2 | 12/2016 |
| WO | 2017/123675 A1 | 7/2017 |
| WO | 2017/186711 A1 | 11/2017 |
| WO | 2017/218358 A1 | 12/2017 |
| WO | 2018/129404 A1 | 7/2018 |
| WO | 2020/097424 A1 | 5/2020 |

OTHER PUBLICATIONS

U.S. Appl. No. 16/619,010, filed Dec. 3, 2019, 2020-0149053, Published.

U.S. Appl. No. 17/291,313, filed May 5, 2021, 2022-0023358, Published.

Nyyssola et al., Production of xylitol from D-xylose by recombinant Lactococcus lactis. J Biotechnol. Jul. 21, 2005;118(1):55-66.

Drees et al., Soluble production of a biologically active single-chain antibody against murine PD-L1 in *Escherichia coli*. Protein Expr Purif. 2014;94:60-66.

Chassoux et al., Therapeutic effect of intratumoral injection of bcg and other substances in rats and mice. Int J Cancer. Oct. 15, 1975;16(4):515-25.

Oelschlaeger, Bacteria as tumor therapeutics? Bioeng Bugs. Mar.-Apr. 2010;1(2):146-7.

Skrnjug et al., The mucosal adjuvant cyclic di-AMP exerts immune stimulatory effects on dendritic cells and macrophages. PLoS One. Apr. 22, 2014;9(4):e95728, 9 pages.

Agorio et al., Live attenuated *Salmonella* as a vector for oral cytokine gene therapy in melanoma. J Gene Med. May 2007,9(5):416-23.

Chen et al., A targeted IL-15 fusion protein with potent anti-tumor activity. Cancer Biol Ther. 2015;16(9):1415-21.

Chen et al., Evaluation of combined vaccinia virus-mediated antitumor gene therapy with p53, IL-2, and IL-12 in a glioma model. Cancer Gene Ther. Nov. 2000;7(11):1437-47.

Choi et al., Concurrent delivery of GM-CSF and B7-1 using an oncolytic adenovirus elicits potent antitumor effect. Gene Ther. Jul. 2006;13(13):1010-20.

Foote et al., A Sting Agonist Given with OX40 Receptor and PD-L1 Modulators Primes Immunity and Reduces Tumor Growth in Tolerized Mice. Cancer Immunol Res. Jun. 2017;5(6):468-479.

Hemminki et al., Enabling successful T-cell therapy of solid tumors with oncolytic adenoviruses armed with TNFa and IL-2. Annals of Oncology. Oct. 2016;27(Suppl 6), Abstract 1080P. 1 page.

Koshy et al., Liposomal Delivery Enhances Immune Activation by STING Agonists for Cancer Immunotherapy. Adv Biosyst. Feb. 2017;1(1-2). pii: 1600013.

Loeffler et al., Attenuated *Salmonella* engineered to produce human cytokine LIGHT inhibit tumor growth. Proc Natl Acad Sci U S A. Jul. 31, 2007;104(31):12879-83.

Loeffler et al., *Salmonella typhimurium* engineered to produce CCL21 inhibit tumor growth. Cancer Immunol Immunother. May 2009;58(5):769-75.

Mangesha et al., Development of a flexible and potent hypoxiainducible promoter for tumor-targeted gene expression in attenuated *Salmonella*. Cancer Biol Ther. Sep. 2006;5(9):1120-8.

Thorne, Adding STING to the Tale of Oncolytic Virotherapy. Trends Cancer. Feb. 1, 2016;2(2):67-68.

Whatcott et al., Targeting the tumor microenvironment in cancer: why hyaluronidase deserves a second look. Cancer Discov. Sep. 2011;1(4):291-6.

Zhou et al., STING-mediated DNA sensing in cancer immunotherapy. Sci China Life Sci. Jun. 2017;60(6):563-574.

International Preliminary Report on Patentability for Application No. PCT/US2018/012698, dated Jul. 18, 2019, 14 pages.

International Search Report and Written Opinion for Application No. PCT/US2018/012698, dated Jun. 5, 2018, 22 pages.

International Search Report and Written Opinion for Application No. PCT/US2018/041705, dated Dec. 6, 2018, 24 pages.

(56) References Cited

OTHER PUBLICATIONS

Invitation to Pay Additional Fees for Application No. PCT/US2018/012698, dated Apr. 9, 2018, 18 pages.
Invitation to Pay Additional Fees for Application No. PCT/US2018/041705, dated Sep. 24, 2018, 16 pages.
International Preliminary Report on Patentability for Application No. PCT/US2018/041705, dated Jan. 23, 2020, 16 pages.
Arrach et al., *Salmonella* promoters preferentially activated inside tumors. Cancer Res. Jun. 15, 2008;68(12):4827-32.
Becker et al., Exploitation of prokaryotic expression systems based on the salicylate-dependent control circuit encompassing nahR/P(sal)::xylS2 for biotechnological applications. Bioeng Bugs. Jul.-Aug. 2010;1(4):244-51.
Brader et al., *Escherichia coli* Nissle 1917 facilitates tumor detection by positron emission tomography and optical imaging. Clin Cancer Res. Apr. 15, 2008;14(8):2295-302.
Chen et al., Oncology meets immunology: the cancer-immunity cycle. Immunity. Jul. 25, 2013;39(1):1-10.
Cronin et al., Bacterial vectors for imaging and cancer gene therapy: a review. Cancer Gene Ther. Nov. 2012;19(11):731-40.
Cronin et al., Bacterial-mediated knockdown of tumor resistance to an oncolytic virus enhances therapy. Mol Ther. Jun. 2014;22(6):1188-1197.
Danino et al., Programmable probiotics for detection of cancer in urine. Sci Transl Med. May 27, 2015;7(289):289ra84, 12 pages.
Datsenko et al., One-step inactivation of chromosomal genes in *Escherichia coli* K-12 using PCR products. Proc Natl Acad Sci U S A. Jun. 6, 2000;97(12):6640-5.
Din et al., Synchronized cycles of bacterial lysis for in vivo delivery. Nature. 12 pages, pre-publication, (2016).
Durand et al., Reprogramming of anaerobic metabolism by the FnrS small RNA. Mol Microbiol. Mar. 2010;75(5):1215-31.
Eike et al., The Cytolytic Amphipathic beta(2,2)-Amino Acid LTX-401 Induces DAMP Release in Melanoma Cells and Causes Complete Regression of B16 Melanoma. PLoS One. Feb. 16, 2016;11(2):e0148980. 19 pages.
Eng et al., Ammonia derived from glutaminolysis is a diffusible regulator of autophagy. Sci Signal. Apr. 27, 2010;3(119):ra31. 10 pages.
European Medicines Agency, Assessment Report for Yervoy (ipilimumab), Procedure No. EMEA/H/002213. 71 pages, May 19, 2011.
Farber et al., Immunological memory: lessons from the past and a look to the future. Nat Rev Immunol. Feb. 2016;16(2):124-8.
Forbes, Engineering the perfect (bacterial) cancer therapy. Nat Rev Cancer. Nov. 2010;10(11):785-94.
Geiger et al., L-Arginine Modulates T Cell Metabolism and Enhances Survival and Anti-tumor Activity. Cell. Oct. 20, 2016;167(3):829-842.
Georgiou, A Therapeutic Enzyme for Highly Effective Immune Checkpoint Inhibition in Cancer. Slideshow, 19 pages, (2015).
Grosso et al., CTLA-4 blockade in tumor models: an overview of preclinical and translational research. Cancer Immunity. Jan. 22, 2013;13(5):1-14.
Hill et al., Magnetic resonance imaging of tumors colonized with bacterial ferritin-expressing *Escherichia coli*. PLoS One. 2011;6(10):e25409. 9 pages.
Hoffman, Bacterial Therapy of Cancer, Methods and Protocols. Humana Press. 193 pages, (1984).
Knee et al., Rationale for anti-GITR cancer immunotherapy. Eur J Cancer. Nov. 2016;67:1-10.
Li et al., Promising Targets for Cancer Immunotherapy: TLRs, RLRs, and STING-Mediated Innate Immune Pathways. Int J Mol Sci. Feb. 14, 2017;18(2). pii: E404. 19 pages.
Marabelle et al., Intratumoral immunization: a new paradigm for cancer therapy. Clin Cancer Res. Apr. 1, 2014;20(7):1747-56.
Mengesha et al., Development of a flexible and potent hypoxia-inducible promoter for tumor-targeted gene expression in attenuated *Salmonella*. Cancer Biol Ther. Sep. 2006;5(9):1120-8.
Piao et al., Enhancement of T-cell-mediated anti-tumour immunity via the ectopically expressed glucocorticoid-induced tumour necrosis factor receptor-related receptor ligand (GITRL) on tumours. Immunology. Aug. 2009;127(4):489-99.
Reichert, Antibodies to watch in 2016. MAbs. 2016;8(2):197-204.
Ryan et al., Bacterial delivery of a novel cytolysin to hypoxic areas of solid tumors. Gene Ther. Mar. 2009;16(3):329-39.
Sagiv-Barfi et al., Eradication of spontaneous malignancy by local immunotherapy. Sci Transl Med. Jan. 31, 2018;10(426). pii: eaan4488. 13 pages.
Sanmamed et al., Defining the optimal murine models to investigate immune checkpoint blockers and their combination with other immunotherapies. Ann Oncol. Jul. 2016;27(7):1190-8.
Spinelli et al., Metabolic recycling of ammonia via glutamate dehydrogenase supports breast cancer biomass. Science. 10.1126/science.aam9305, pre-publication. 12 pages, (2017).
Stritzker et al., Myristoylation negative msbB-mutants of probiotic *E. coli* Nissle 1917 retain tumor specific colonization properties but show less side effects in immunocompetent mice. Bioeng Bugs. Mar.-Apr. 2010;1(2):139-45.
Stritzker et al., Enterobacterial tumor colonization in mice depends on bacterial metabolism and macrophages but is independent of chemotaxis and motility. Int J Med Microbiol. Nov. 2010;300(7):449-56.
Stritzker et al., Tumor-specific colonization, tissue distribution, and gene induction by probiotic *Escherichia coli* Nissle 1917 in live mice. Int J Med Microbiol. Jun. 2007;297(3):151-62.
Van Der Woude et al., Migrating into the Tumor: a Roadmap for T Cells. Trends Cancer. Nov. 2017;3(11):797-808.
Van Pijkeren et al., A novel Listeria monocytogenes-based DNA delivery system for cancer gene therapy. Hum Gene Ther Apr. 2010;21(4):405-16.
Vargas et al., Rationale for stimulator of interferon genes-targeted cancer immunotherapy. Eur J Cancer. Apr. 2017;75:86-97.
Vonderheide, The Immune Revolution: A Case for Priming, Not Checkpoint. Cancer Cell. Apr. 9, 2018;33(4):563-569.
Written Opinion for Application No. PCT/US2015/047475, dated Feb. 2, 2016, 6 pages.
International Search Report and Written Opinion for Application No. PCT/US2017/013072, dated May 19, 2017, 19 pages.
Corrales et al., Direct Activation of STING in the Tumor Microenvironment Leads to Potent and Systemic Tumor Regression and Immunity. Cell Rep. May 19, 2015;11(7):1018-30.
Leventhal et al., Immunotherapy with engineered bacteria by targeting the STING pathway for anti-tumor immunity. Nat Commun. Jun. 1, 2020;11(1):2739.
Quintana et al., Genetic Engineering of Lactococcus lactis Co-producing Antigen and the Mucosal Adjuvant 3' 5'-cyclic di Adenosine Monophosphate (c-di-AMP) as a Design Strategy to Develop a Mucosal Vaccine Prototype. Front Microbiol. Sep. 4, 2018;9:2100.
Shang et al., Research progress on anti-tumor and immunomodulatory effects of bacterial preparations. Journal of Tianjin Medical University. Sep. 2006;12(3):474-477.

* cited by examiner

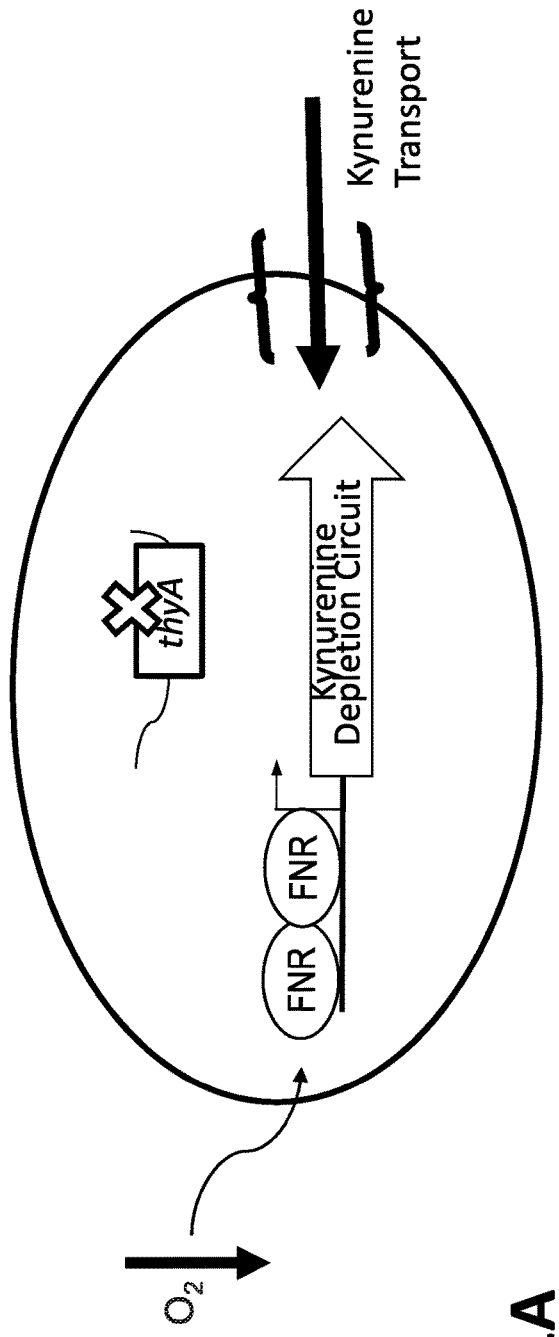
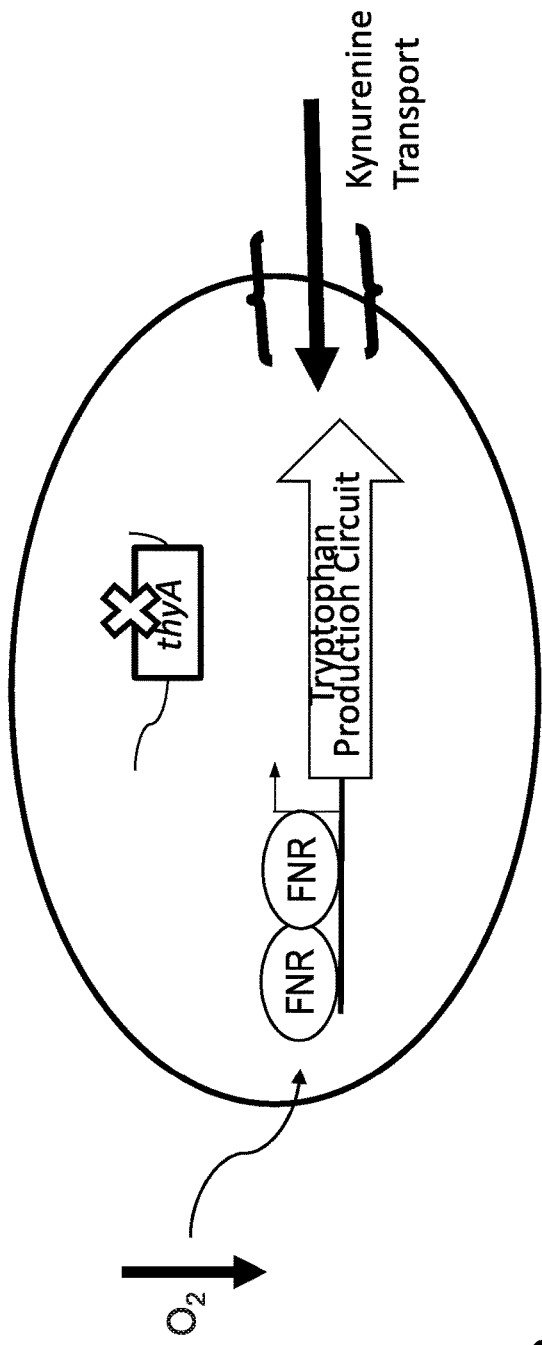
FIG. 1A
FIG. 1B

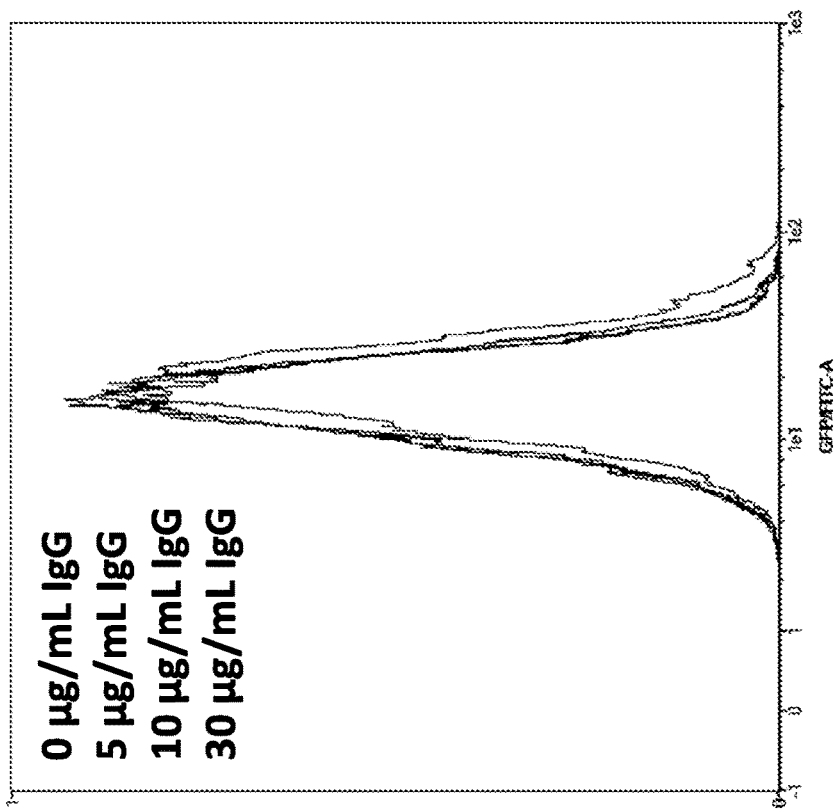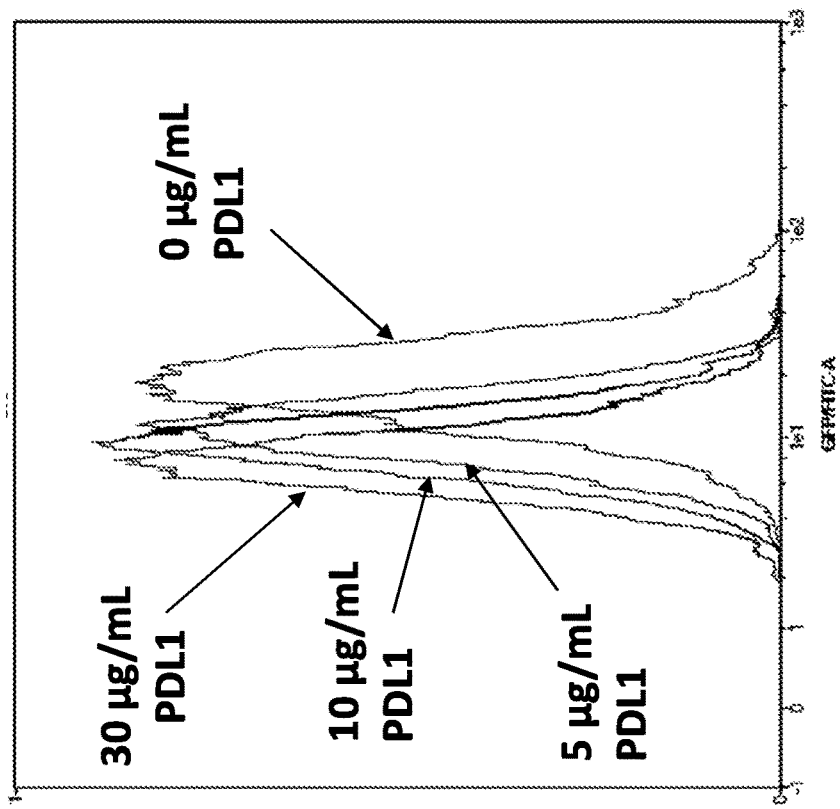
FIG. 35 e.g., Escherichia coli Nissle, K-12, Listeria monocytogenes, C. butryicum, Clostridium novyi-NT e.g., *Escherichia coli Nissle, K-12, Listeria monocytogenes, C. butryicum, Clostridium novyi-NT* e.g., *Escherichia coli* Nissle, K-12, *Listeria monocytogenes*, *C. butryicum*, *Clostridium novyi-NT* e.g., Escherichia coli Nissle, K-12, Listeria monocytogenes, C. butryicum, Clostridium novyi-NT e.g., Escherichia coli Nissle, K-12, Listeria monocytogenes, C. butryicum, Clostridium novyi-NT e.g., *Escherichia coli Nissle, K-12, Listeria monocytogenes, C. butryicum, Clostridium novyi-NT* e.g., *Escherichia coli Nissle, K-12, Listeria monocytogenes, C. butryicum, Clostridium novyi-NT* e.g., *Escherichia coli Nissle, K-12, Listeria monocytogenes, C. butryicum, Clostridium novyi-NT*

Synthetic Biotics: Single Product; Multiple MoAs

Immune stimulatory
e.g., IL-12, IL-2, IL-15, IL-18, IL-7, IL-21, CD40 agonist, CD40 agonist, CD226 agonist, CD137 agonist, ICOS agonist, OXO40 agonist, GM-CSF

Checkpoint Inhibitor
e.g., Anti-PD-1, anti-CTLA-4, anti-LAG3, anti-TIM3, and/or anti-PD-L1

Metabolite Modulators
e.g., tryptophan, kynurenase, arginase, and/or IDO/TDO inhibition

*E. coli* 1917 Nissle chromosome

FIG. 52

Synthetic Biotics: Single Product; Multiple MoAs

Immune stimulatory
e.g., IL-12, IL-2, IL-15, IL-18, IL-7, IL-21, CD40 agonist, CD40 agonist, CD226 agonist, CD137 agonist, ICOS agonist, OXO40 agonist, GM-CSF

Checkpoint Inhibitor
e.g., Anti-PD-1, anti-CTLA-4, anti-LAG3, anti-TIM3, and/or anti-PD-L1

Metabolite Modulators
e.g., tryptophan, kynurenase, arginase, and/or IDO/TDO inhibition

Cytotoxin
e.g., Lytic peptides and other cytotoxins

*E. coli* 1917 Nissle chromosome

FIG. 53

Synthetic Biotics: Single Product; Multiple MoAs

Immune stimulatory e.g., IL-12, IL-2, IL-15, IL-18, IL-7, IL-21, CD40 agonist, CD40 agonist, CD226 agonist, CD137 agonist, ICOS agonist, OXO40 agonist, GM-CSF

Checkpoint Inhibitor e.g., Anti-PD-1, anti-CTLA-4, anti-LAG3, anti-TIM3, and/or anti-PD-L1

E. coli 1917 Nissle chromosome

FIG. 57

Synthetic Biotics: Single Product; Multiple MoAs

Immune stimulatory e.g., IL-12, IL-2, IL-15, IL-18, IL-7, IL-21, CD40 agonist, CD40 agonist, CD226 agonist, CD137 agonist, ICOS agonist, OXO40 agonist, GM-CSF

*E. coli* 1917 Nissle chromosome

Metabolite Modulators e.g., tryptophan, kynurenase, arginase, and/or IDO/TDO inhibition

FIG. 59

Brightness of constitutive RFP integrated in three locations:
1. AraB/C
2. MalE/K
3. MetY/ArgG
4. Nissle (non-fluorescent)

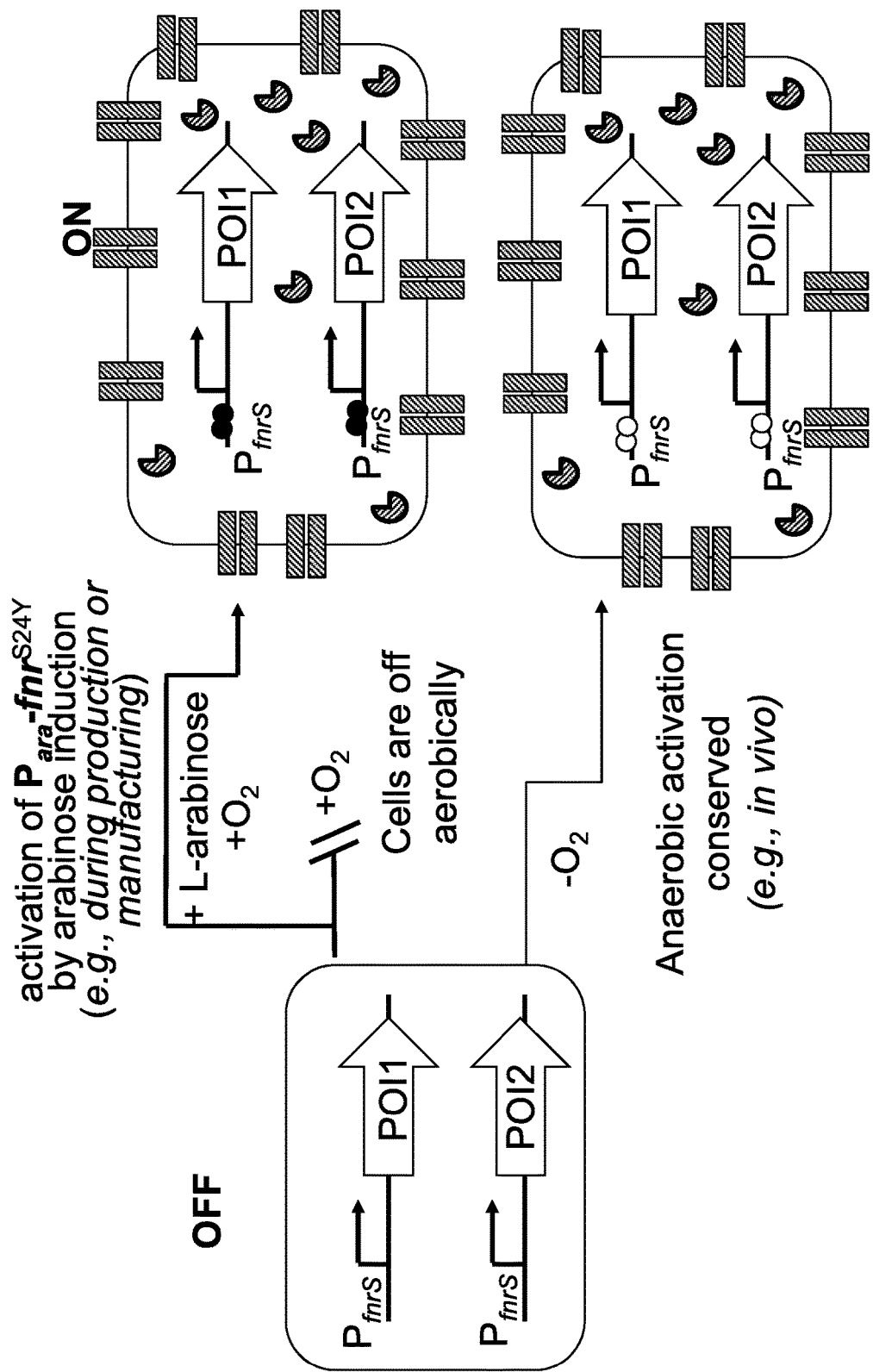

MICROORGANISMS PROGRAMMED TO PRODUCE IMMUNE MODULATORS AND ANTI-CANCER THERAPEUTICS IN TUMOR CELLS

RELATED APPLICATIONS

This application is a 35 U.S.C. § 371 national stage filing of International Application No. PCT/US2017/013072, filed on Jan. 11, 2017, which in turn claims priority to U.S. Provisional Patent Application No. 62/277,450, filed on Jan. 11, 2016; U.S. Provisional Patent Application No. 62/297,778, filed on Feb. 19, 2016; U.S. Provisional Patent Application No. 62/305,462, filed on Mar. 8, 2016; U.S. Provisional Patent Application No. 62/313,691, filed on Mar. 25, 2016; U.S. Provisional Patent Application No. 62/314,322, filed on Mar. 28, 2016; U.S. Provisional Patent Application No. 62/277,455, filed on Jan. 11, 2016; U.S. Provisional Patent Application No. 62/335,940, filed on May 13, 2016; U.S. Provisional Patent Application No. 62/348,360, filed on Jun. 10, 2016; U.S. Provisional Patent Application No. 62/443,639, filed on Jan. 6, 2017; U.S. Provisional Patent Application No. 62/293,749, filed on Feb. 10, 2016; U.S. Provisional Patent Application No. 62/347,508, filed on Jun. 8, 2016; U.S. Provisional Patent Application No. 62/347,567, filed on Jun. 8, 2016; U.S. Provisional Patent Application No. 62/348,699, filed on Jun. 10, 2016; U.S. Provisional Patent Application No. 62/354,682, filed on Jun. 24, 2016; U.S. Provisional Patent Application No. 62/362,954, filed on Jul. 15, 2016; U.S. Provisional Patent Application No. 62/385,235, filed on Sep. 8, 2016; U.S. Provisional Patent Application No. 62/423,170, filed on Nov. 16, 2016 and U.S. Provisional Patent Application No. 62/439,871, filed on Dec. 28, 2016; and which is a continuation-in-part of PCT Application No. PCT/US2016/032565, filed on May 13, 2016; a continuation-in-part of U.S. patent application Ser. No. 15/164,828, filed on May 25, 2016; and a continuation-in-part of PCT Application No. PCT/US2016/034200, filed on May 25, 2016; the entire contents of each of which are expressly incorporated herein by reference.

SEQUENCE LISTING

The instant application contains a Sequence Listing which has been submitted electronically in ASCII format and is hereby incorporated by reference in its entirety. Said ASCII copy, created on Jul. 10, 2018, is named 126046-01322 SL.txt and is 894,384 bytes in size.

BACKGROUND OF THE INVENTION

Current cancer therapies typically employ the use of immunotherapy, surgery, chemotherapy, radiation therapy, or some combination thereof (American Cancer Society). While these drugs have shown great benefits to cancer patients, many cancers remain difficult to treat using conventional therapies. In addition, the systemic administration of such therapies often results in adverse effects to normal or healthy tissues leading to severe adverse events such as those associated with immune-related adverse events. Conventional therapies for cancer such as chemotherapy and radiotherapy are characterized by poor survival rates due to a variety of factors including development of drug-resistance and their lack of tumor specificity, resulting in undesirable side effects on healthy cells and therefore limitations on therapeutic dose.

Currently, many conventional cancer therapies are administered systemically and adversely affect healthy tissues, resulting in significant side effects. For example, many cancer therapies focus on activating the immune system to boost the patient's anti-tumor response (Kong et al., 2014). However, despite such therapies, the microenvironment surrounding tumors remains highly immune suppressive. In addition, systemic altered immunoregulation provokes immune dysfunction, including the onset of opportunistic autoimmune disorders and immune-related adverse events.

The immune system is finely regulated to protect from invading pathogens, while avoiding immune responses mounted against the host's own cells. In T cells, "immune checkpoints" prevent the development of immune reactions against the host and the development of autoimmune diseases, such as rheumatoid arthritis, lupus, and multiple sclerosis. Several cancer drugs aim to inhibit these immune checkpoints, including ipilimumab and tremelimumab (which target CTLA-4) and prembrolizumab and nivolumab (which target PD-1), in order to allow the immune system in cancer patients to mount immune responses against cancer antigens. While these drugs have shown great benefits to cancer patients, data from clinical trials also indicate that these drugs are associated with breaking tolerance against many self-antigens beyond the tumor, thus leading to the emergence of autoimmune responses. Because these cancer drugs are administered systemically, they circulate throughout the patient and inhibit T cell checkpoints indiscriminately, which causes T cells to mount anti-self responses. In a recent clinical trial with ipilimimab, the majority of subjects (85%) reported immune-related adverse events, such as diarrhea, dermatitis, hepatitis, hypophysitis and other conditions, any of which conditions may be sufficiently toxic to require either discontinuation of therapy or the supplementation of systemic immunosuppressive therapy (e.g., corticosteroid or α-TNF therapy). (Downey et al., Clin Cancer Res (2007) 13:6681; Horvat et al., J. Clin. Oncology (2015) 33: 3193-3198). Recent emerging technologies involve the use of dual combinations of immune modulators, e.g., anti-PD-1 and anti-CTLA-4, however, such combination therapies when administered systemically show undesired toxicity.

It is also known that some cancer patients have a strong immune response against a tumor—in the form of T cells that infiltrate the tumor, while others have significantly diminished immune response. Differences in immune responses to cancer may be due to genetic variants, differences in the tumor mutations, environmental differences, or a combination of these factors. Recent studies have suggested that the presence of certain types of gut microbes in mice can enhance the anti-tumor effects of cancer immunotherapy without increasing toxic side effects (M. Vétizou et al., "Anticancer immunotherapy by CTLA-4 blockade relies on the gut microbiota," Science, doi:10.1126/aad1329, 2015; A. Sivan et al., "Commensal *Bifidobacterium* promotes antitumor immunity and facilitates anti-PD-L1 efficacy," Science, doi:0.1126/science.aac4255, 2015). Whether the gut microbial species identified in these mouse studies will have the same effect in people is not clear.

In addition, certain tumors are particularly difficult to manage using conventional therapies. Hypoxia is a characteristic feature of solid tumors, wherein cancerous cells are present at very low oxygen concentrations. Regions of hypoxia often surround necrotic tissues and develop as solid forms of cancer outgrow their vasculature. When the vascular supply is unable to meet the metabolic demands of the tumor, the tumor's microenvironment becomes oxygen deficient. Multiple areas within tumors contain <1% oxygen, compared to 3-15% oxygen in normal tissues (Vaupel and Hockel, 1995), and avascular regions may constitute 25-75% of the tumor mass (Dang et al., 2001). Approximately 95% of tumors are hypoxic to some degree (Huang et al., 2004). Systemically delivered anticancer agents rely on tumor vasculature for delivery, however, poor vascularization impedes the oxygen supply to rapidly dividing cells, rendering them less sensitive to therapeutics targeting cellular proliferation in poorly vascularized, hypoxic tumor regions. Radiotherapy fails to kill hypoxic cells because oxygen is a required effector of radiation-induced cell death. Hypoxic cells are up to three times more resistant to radiation therapy than cells with normal oxygen levels (Bettegowda et al., 2003; Tiecher, 1995; Wachsberger et al., 2003). For all of these reasons, nonresectable, locally advanced tumors are particularly difficult to manage using conventional therapies.

In addition to the challenges associated with targeting a hypoxic environment, therapies that specifically target and destroy cancers must recognize differences between normal and malignant tissues, including genetic alterations and pathophysiological changes that lead to heterogeneous masses with areas of hypoxia and necrosis.

Thus, there is an unmet need for effective cancer therapies that are able to target poorly vascularized, hypoxic tumor regions specifically target cancerous cells, while minimally affecting normal tissues and boost the immune systems to fight the tumors, including avoiding or reversing the cancer immunotolerance.

SUMMARY

Major efforts have been made over the past few decades to develop cytotoxic drugs that specifically target cancer cells. In recent years there has been a paradigm shift in oncology in which the clinical problem of cancer is considered not only to be the accumulation of genetic abnormalities in cancer cells but also the tolerance of these abnormal cells by the immune system. Consequently, recent anti-cancer therapies have been designed specifically to target the immune system rather than cancer cells. Such therapies aim to reverse the cancer immunotolerance and stimulate an effective antitumor immune response. For example, current immunotherapies include immunostimulatory molecules that are pattern reconition receptor (PRR) agonists or immunostimulatory monoclonal antibodies that target various immune cell populations that infiltrate the tumor microenvironment. However, despite their immune-targeted design, these therapies have been developed clinically as if they were conventional anticancer drugs, relying on systemic administration of the immunotherapeutic (e.g., intravenous infusions every 2-3 weeks). As a result, many current immunotherapies suffer from toxicity due to a high dosage requirement and also often result in an undesired autoimmune response or other immune-related adverse events.

The present disclosure provides compositions, methods, and uses of microorganisms that selectively target tumors and tumor cells and are able to produce one or more anti-cancer molecules, e.g., immune modulator(s), which are produced locally at the tumor site. In certain aspects, the present disclosure provides microorganisms, such as bacteria or virus, that are engineered to produce one or more anti-cancer molecule(s), e,g, immune modulators. Such engineered microorganisms can be targeted to cancer cells and/or tumor sites(s) for the selective delivery of gene circuits or cassettes comprising one or more anti-cancer molecules, to diseased tissue microenvironments in vivo. In certain aspects, the engineered microorganism is a bacteria, e.g., *Salmonella typhimurium, Escherichia coli* Nissle, *Clostridium novyi* NT, and *Clostridium butyricum* miyairi, as well as other exemplary bacterial strains provided herein, are able to selectively home to tumor microenvironments. Thus, in certain embodiments, the engineered microorganisms are administered systemically, e.g., via oral administration, intravenous injection, subcutaneous injection, or other means, and are able to selectively colonize a tumor site. For example, *E. coli* Nissle 1917 has been shown to selectively home into tumor tissue in rodent models of liver metastasis following oral delivery, but does not colonize healthy organs or fibrotic liver tissue. (Danino et al, 2015; Stritzker et al., Int J Med Micro, 297:151-162 (2007)). In other embodiments, the engineered microorganism, such as a bacteria or virus, are delivered locally (directly) to the tumor site or microenvironment, e.g., via intratumoral administration, such as intratumoral injection.

In other aspects, the present disclosure provides engineered oncolytic viruses that are engineered to produce one or more anti-cancer molecules, e.g., immune modulators. Some oncolytic viruses are naturally able to specifically target, infect and lyse cancer cells, and leave non-cancer cells intact. Thus, oncolytic viruses are able to selectively replicate in cancer cells and can also spread within a tumor without causing damage to normal tissue. Other oncolytic viruses can be genetically engineered for safe and selective cancer cell targeting. Tumor-specificity can be achieved through a number of different strategies involving the insertion of foreign sequences or deletion of native viral sequences to exploit tumor-specific attributes or defects in gene expression. Examples of such strategies are discussed elsewhere herein. Such engineered oncolytic viruses can be advantageously targeted to cancer cells and/or tumor sites(s) for the selective delivery of gene circuits comprising one or more anti-cancer molecules to diseased tissue microenvironments in vivo. In certain aspects, the engineered oncolytic viruses (naturally or altered viruses), e.g., HSV-1, adenoviruses, vaccinia virus, Newcastle disease virus, reovirus, Seneca valley virus, measles virus, poliovirus, and coxsackievirus, as well as other exemplary viruses provided herein, are able to selectively home to tumor microenvironments. Thus, in certain embodiments, the engineered oncolytic viruses are administered systemically, e.g., via oral administration, intravenous injection, subcutaneous injection, or other means, and are able to selectively colonize a tumor site. In other embodiments, the engineered oncolytic viruses are delivered locally (directly) to the tumor site or microenvironment, e.g., via intratumoral injection.

The present disclosure provides engineered microorganisms that selectively home to tumor microenvironments or that are administered locally to a tumor site, to deliver one or more anti-cancer molecules. Local delivery of an anti-cancer molecule, e.g., immunomodulatory agent, to the tumor microenvironment is advantageous because it allows a much higher concentration of the therapeutic agent (anti-cancer molecule(s)) to be delivered as compared with systemic delivery, which often results in autoimmune toxicity. Furthermore, recent evidence supports the idea that immunomodulatory agents, such as receptor agonists and immunostimulatory antibodies, delivered directly to a tumor, even at a single site, can generate a systemic or adaptive antitumor immune response by targeting immune cells present in the tumor microenvironment. Such immune cells include, for example, mature antigen-presenting cells, helper and effector cytotoxic T cells, tolergenic dendritic cells, tumor-associated macrophages and regulatory T cells, among other cell types, that infiltrate and/or surround the tumor site. Thus, in some aspects, the present disclosure provides microorganisms that selectively target tumor cells and are able to produce one or more anti-cancer molecules which are delivered locally to the tumor site to produce a local intratumoral immune response. This results in the induction of a tumor-selective adaptive immune response which is advantageous over other methods as it avoids generating an immune response to ato-antigens.

In certain aspects, the engineered microorganisms produce one or more anti-cancer molecules that target intratumoral immune cells (e.g., that infiltrate the tumor microenvironment). In certain embodiments, the anti-cancer molecule(s) produced by the engineered microorganism generates an innate antitumor immune response. In certain embodiments, the anti-cancer molecule(s) produced by the engineered microorganism generates a local antitumor immune response. In certain embodiments, the anti-cancer molecule(s) produced by the engineered microorganism generates a systemic or adaptive antitumor immune response. Examples of suitable anti-cancer molecules are described herein.

In addition to producing an anti-cancer molecule(s) that triggers an immune response, the engineered microorganisms themselves are advantageous in that they can generate an antitumor immune response, e.g., a local or innate immune response that develops into a systemic or adaptive immune response. For example, the engineered microorganism can stimulate the antigen-presenting ability of immune cells that infiltrate the tumor microenvironment (e.g., B cells, plasmacytoid and myeloid dendritic cells (DCs), CD4+ Tcells, CD8+ Tcells, Tregs, natural killer cells (NK cells), and tumor-associated macrophages (TAMs)). Many immune cells found in the tumor microenvironment express pattern recognition receptors (PRRs), which receptors play a key role in the innate immune response through the activation of pro-inflammatory signaling pathways, stimulation of phagocytic responses (macrophages, neutrophils and dendritic cells) or binding to micro-organisms as secreted proteins. PRRs recognize two classes of molecules: pathogen-associated molecular patterns (PAMPs), which are associated with microbial pathogens, and damage-associated molecular patterns (DAMPs), which are associated with cell components that are released during cell damage, death stress, or tissue injury. PAMPS are unique to each pathogen and are essential molecular structures required for the pathogens survival, e.g., bacterial cell wall molecules (e.g. lipoprotein), viral capsid proteins, and viral and bacterial DNA. PRRs can identify a variety of microbial pathogens, including bacteria, viruses, parasites, fungi, and protozoa. PRRs are primarily expressed by cells of the innate immune system, e.g., antigen presenting macrophage and dendritic cells, but can also be expressed by other cells (both immune and non-immune cells), and are either localized on the cell surface to detect extracellular pathogens or within the endosomes and cellular matrix where they detect intracellular invading viruses.

Examples of PRRs include Toll-like receptors (TLR), which are type 1 transmembrane receptors that have an extracellular domain which detects infecting pathogens. TLR1, 2, 4, and 6 recognize bacterial lipids, TLR3, 7 and 8 recognize viral RNA, TLR9 recognizes bacterial DNA, and TLR5 and 10 recognize bacterial or parasite proteins. (see Table 5 below, for examples of cells in the tumor microenvironment that express TLRs). Other examples of PRRs include C-type lectin receptors (CLR), e.g., group I mannose receptors and group II asialoglycoprotein receptors, cytoplasmic (intracellular) PRRs, nucleotide oligomerization (NOD)-like receptors (NLRs), e.g., NOD1 and NOD2, retinoic acid-inducible gene I (RIG-I)-like receptors (RLR), e.g., RIG-I, MDA5, and DDX3, and secreted PRRs, e.g., collectins, pentraxins, ficolins, lipid transferases, peptidoglycan recognition proteins (PGRs) and the leucine-rich repeat receptor (LRR).

Upon detection of a pathogen (e.g., stimulation by PAMP or DAMP), PRRs initiate the activation of signalling pathways, such as the NF-kappa B pathway, that stimulates the production of co-stimulatory molecules and pro-inflammatory cytokines, e.g., type I IFNs, IL-6, TNF, and IL-12, which mechanisms play a role in the activation of inflammatory and immune responses mounted against infectious pathogens. Such response triggers the activation of immune cells present in the tumor microenvironment that are involved in the adaptive immune response (e.g., antigen-presenting cells (APCs) such as B cells, DCs, TAMs, and other myeloid derived suppressor cells). Recent evidence indicates that immune mechanisms activated by PAMPs and DAMPs play a role in activating immune responses against tumor cells as well. For example, studies have shown that TLR activation of APCs within mice and in the human tumor microenvironment modifies their phenotype from tolergenic to immunogenic, with the up-regulation of class II MHC, CD80, and CD86, which activation is required to sustain the development of an efficient adaptive antitumor immune response. (LeMercier et al., Canc Res, 73:4629-40 (2013); Kim et al., Blood, 119:355-63 (2012)).

Furthermore, TLRs can also be expressed by tumor cells. The direct activation of TLRs on cancer cells can result in the death of the targeted tumor cell and/or up-regulate antigen presenting molecules, e.g., in the case of B-cell lymphomas, for example. Thus, upon chemotherapy, tumor-targeted therapy, or other therapy that causes tumor cell death, the tumor cells can release endogenous DAMPs, which are recognized by TLR or other PRR on tumor-infiltrating immune cells and cells surrounding the tumor cells, and activate an immune response. Such agonists (e.g., DAMPs) stimulate the antitumor response via activation of APCs infiltrating the tumor, effectively mounting an adaptive antitumor response against tumor-associated antigen.

Another PRR subfamily are the RIG-I-like receptors (RLRs) which are considered to be sensors of double-stranded viral RNA upon viral infection and which can be targeted for intratumoral immune stimulation. Upon stimulation, for example, upon intratumoral delivery of an oncolytiv virus, RLRs trigger the release of type I IFNs by the host cell and result in its death by apoptosis. Such cytokine and tumor-associated antigen (TAA) release also results in the activation of the antitumor immune response. Given that RLRs are endogenously expressed in all tumor types, they are a universal proimmunogenic therapeutic target and of particular relevance in the immune response generated by local delivery of an oncolytic virus.

Tumor responses have long been observed upon intratumoral delivery of pathogens, such as microorganisms of the disclosure, e.g., bacteria and oncolytic viruses, and have been shown to provide therapeutic benefit in several types of cancers, including solid tumors, melanoma, basal cell carcinomas, and squamous cell carcinoma, which effects are, in part, due to the proinflammatory properties of the nucleic acid fractions, capsid proteins, and/or cell wall fractions of microorganisms that activate PRRs. For example, intratumoral injections of extracts from bacteria, *Streptococcus pneumoniae* and *Serratia marcescens*) have shown therapeutic effect for solid tumors. Intratumoral injections of *Bacillus* Calmette-Guerin (BCG) have shown therapeutic benefits to several different types of cancers, including melanoma and squamous cell carcinoma, due, in part, to the ability of BCG DNA and cell wall slelton to activate PRRs (Morton et al, Ann Surg, 1974, 180:635-43; Melvin et al., JAMA, 1974, 229:688; Krown et al. m Cancer, 1978, 42:2648-60; Bier et al., Cancer Immunol, 1981, 12:71-79; Hortobagyi et al., Cancer, 1978, 42:2293-2303; Bast et al., N Engl J Med, 1974, 290:1458-69; Shimada et al., J Natl Cancer Inst, 1985, 74:681-8; Tokunaga et al., Jpn J Infect Dis, 1999, 52:1-11; Krieg et al., Nature, 1995, 374:546-9; Neville et al., Nat Clin Pract Oncol, 2007, 4: 462-9; Ryan et al., Bioessays. 2006 January; 28(1):84-94; Baban et al., Bioengineered Bugs 1:6, 385-394; November/December 2010).

Systemic immune effects have also been observed using oncolytic virus therapy, due, in part, to the ability of their viral DNA and/or their capsid proteins to act as PRR agonists. Intratumoral delivery of oncolytic viruses have been shown to generate a systemic antitumor immune response, for example, in liver cancer and hepatocellular carcinoma. Bowie et al., Nat rev Immunol, 2008, 8:911-22; Park et al., Lancet Oncol, 2008, 9:533-542; Heo et al., Nat Med, 2013, 19:329-36).

These approaches have several limitations that have hindered their broad applicability to treating cancer (Ryan et al., BioEssays 28:84-94, (2005). Use of bacteria in anti-cancer therapies; Nallar et al., Cytokine. 2016, Bacteria and genetically modified bacteria as cancer therapeutics: Current advances and challenges; Krzykawski C combined bacterial and viral treatment: a novel anticancer strategy, Cent Eur J Immunol. 2015; 40(3):366-72; Li et al., Live-Attenuated Bacterial Vectors: Tools for Vaccine and Therapeutic Agent Delivery. Vaccines (Basel). 2015 Nov. 10; 3(4):940-72). Most immunotherapies which include bacteria or viruses have also failed (Krzykawski, Centr Eur J Immunol 2015; 40 (3): 366-372). The pathogenic bacteria for instance can cause massive inflammatory response locally and systemically that can lead to significant adverse events, such as sepsis. It is also reported that growing tumor cannot develop healthy vasculature and without one, hypoxic regions appear. As a result of hypoxia and handicapped vascularization, many cells die leaving all the debris in the tumor causing adverse events (Krzykawski, Centr Eur J Immunol 2015; 40 (3): 366-372). Therefore, the bacteria of choice are suggested to be optional or obligatory anaerobes which will limit the spread of the bacteria mainly to the tumor tissue (Dang et al. 2001: Proc Natl Acad Sci USA 98: 15155-15160). Additionally, methods of precise delivery of the therapeutic bacteria to tumors with limited blood supply must be provided.

The microorganisms of the present disclosure, such as engineered non-pathogenic bacteria, can overcome some of the limitations of the earlier approaches by selectively and locally producing one or more anti-cancer molecules at the tumor site, and have the added advantage of being able to activate an intratumoral immune response. In some aspects, the microorganism is able to activate an innate or local immune response. In some aspects, the microorganism is able to activate APCs. In some aspects, the microorganism is able to activate systemic antitumor immunity against distant cancer cells. In some aspects, the microorganism is able to activate adaptive antitumor immunity.

In certain embodiments, the engineered microorganisms produce one or more anti-cancer molecules that target intratumoral immune cells (e.g., immune cells that infiltrate the tumor microenvironment). In certain embodiments, the anti-cancer molecules produced by the engineered microorganisms generate a local antitumor immune response. In certain embodiments, the anti-cancer molecules produced by the engineered microorganisms generate a systemic or adaptive antitumor immune response. In certain embodiments, the anti-cancer molecules produced by the engineered microorganisms generate a systemic or adaptive antitumor immune response against cancer cells distant to the local tumor site (site of intratumoral delivery or injection). In certain aspects, the engineered microorganisms produce one or more anti-cancer molecules that target tumor cells and activate a local and/or systemic immune response.

The specific tumor targeting abilities of systemically administered engineered microorganisms and/or the local (e.g., intratumoral) delivery of engineered microorganisms not only provide a local cytotoxic effect at the tumor site, but also provide a therapeutic systemic anti-tumor immune response (against distant cancers cells and/or uninjected tumor sites) with minimal autoimmune dysfunction or other adverse immune event. Local delivery or selective tumor targeting by the microorganisms prevents the circulation of high concentrations of immune modulators, e.g. immune stimulatory agents, in the blood. Moreover, local or selective tumor delivery of the microrganisms allows much higher concentrations of immunostimulatory agents in the tumor site needed to trigger the adaptive immune response.

In addition to the advantages associated with their ability to selectively target tumor cells (as a result of local delivery or the ability to home to a tumor site), resulting in the production of both a local and adaptive immune response, the engineered microorganisms have the advantage that they can be engineered to produce a combination of anti-cancer molecules, e.g., immune modulators. The engineered microrganisms have a further advantage in that they can be engineered to deliver more than one anti-cancer molecule selectively to the tumor site. For example, the engineered microorganisms can be engineered to produce anti-cancer molecules that, in combination, reverse cancer-induced immunotolerance and also trigger an effective anti-tumor immune response. For example, the engineered microorganisms can be engineered to produce a combination of anti-cancer molecules, one or more that may serve to reverse immune tolerance (or immune suppression) and one or more that may serve to activate antigen presentation and/or stimulate or activate an immune response. Moreover, these anti-cancer molecules can be regulated by an inducible-promoter that is induced in response to environmental conditions found in the tumor microenvironment, e.g., under hypoxic or low-oxygen conditions. This type of regulation further serves to ensure that the anti-cancer molecules are expressed at the tumor site and not expressed in normal or non-cancerous tissue.

Thus, in certain aspects, the engineered microroganisms of the present disclosure are engineered to produce one or more anti-cancer molecules that inhibit or suppress tumor immunotolerance in the tumor microenvironment. In certain aspects, the engineered microroganisms of the present disclosure are engineered to produce one or more anti-cancer molecules that activate or stimulate an antitumor immune response in the tumor microenvironment. In certain aspects, the engineered microroganisms of the present disclosure are engineered to produce one or more anti-cancer molecules that inhibit or suppress tumor immunotolerance and activate or stimulate an antitumor immune response in the tumor microenvironment. In some embodiments, the local suppression of tumor immunotolerance and immune stimulation leads to s systemic adaptive immune response.

Thus, in certain aspects, the engineered microorganisms of the present disclosure are engineered to produce one or more anti-cancer molecules that can either (1) inhibit or suppress or reverse tumor immunotolerance in the local tumor microenvironment, (2) activate or stimulate an antitumor immune response in the local tumor microenvironment, or (3) do both. In certain aspects, the engineered microorganisms of the present disclosure are engineered to produce one or more anti-cancer molecules that can either inhibit or suppress tumor immunotolerance. Examples of anti-cancer molecules that inhibit or suppress or reverse tumor immunotolerance in the local tumor microenvironment include, for example: (1) anti-cancer molecules that inhibit immune checkpoints; (2) anti-cancer molecules inhibit suppressive cytokines and/or chemokines; (3) anti-cancer molecules that inhibit phagocytosis escape; (4) anti-cancer molecules that decrease or deplete metabolites that contribute to immunosuppression; and (5) anti-cancer molecules that inhibit angiogenesis. Thus, the genetically engineered microorganisms of the present disclosure are engineered to produce one or more anti-cancer molecules selected from immune checkpoint inhibitors, inhibitors of suppressive cytokines and/or chemokines, inhibitors of molecules that assist in phagocytosis escape, molecules that decrease or deplete metabolites that contribute to immunosuppression, inhibitors of molecules that promote angiogenesis, and combinations thereof. Non-limiting examples of these molecules are described herein below.

In certain aspects, the engineered microorganisms of the present disclosure are engineered to produce one or more anti-cancer molecules that can activate or stimulate an antitumor immune response. Examples of anti-cancer molecules that activate or stimulate an antitumor immune response in the local tumor microenvironment include, for example: (1) immunostimulatory cytokines; (2) co-stimulation molecules that work with other immune molecules, e.g., immunostimulatory cytokines, to stimulate an immune response; (3) antibodies that promote immune engagement; (4) immune molecules involved in adoptive effector cell therapy; (5) tumor antigens that serve as vaccines, and (6) cytotoxins or lytic peptides. Thus, the genetically engineered microorganisms of the present disclosure are engineered to produce one or more anti-cancer molecules selected from immunostimulatory cytokines, co-stimulation molecules that work with other immune molecules to stimulate an immune response, antibodies that promote immune engagement, immune molecules involved in adoptive effector cell therapy, tumor antigens that serve as vaccines, cytotoxins or lytic peptides, and combinations thereof. Non-limiting examples of these molecules are described herein below.

In any of these embodiments, the engineered microorganism is an engineered bacterium. In any of these embodiments, the engineered microorganism is an engineered oncolytic virus. In any of these embodiments, the engineered microorganism is a tumor-targeting engineered bacterium or a tumor-targeting engineered oncolytic virus. In some embodiments, the tumor-targeting engineered bacterium or a tumor-targeting engineered oncolytic virus naturally homes to cancer cells and/or to a tumor site. In some embodiments, the tumor-targeting engineered bacterium or a tumor-targeting engineered oncolytic virus is engineered to so that it targets cancer cells and/or to a tumor site, e.g., comprises non-native gene sequence(s) that provide tumor-targeting capability. In any of these embodiments, the engineered bacteria and/or the engineered oncolytic virus is engineered to produce one or more anti-cancer molecules that inhibit or suppress tumor immunotolerance and also to produce one or more anti-cancer molecules that activate or stimulate an antitumor immune response. In some embodiments, the engineered bacteria or engineered oncolytic virus is engineered to produce one or more anti-cancer molecules under the control of a promoter that is activated by low-oxygen conditions. In some embodiments, the genetically engineered bacterium or genetically engineered oncolytic virus is a tumor-targeting bacterium or tumor-targeting oncolytic virus that expresses one or more anti-cancer molecules under the control of a promoter that is activated by low-oxygen conditions. In certain embodiments, the genetically engineered bacteria or genetically engineered oncolytic viruses express one or more anti-cancer molecules under the control of a promoter that is activated by hypoxic conditions, or by inflammatory conditions, such as any of the promoters activated by said conditions and described herein. In some embodiments, the genetically engineered bacteria or genetically engineered OV express one or more anti-cancer molecules under the control of a cancer-specific promoter, a tissue-specific promoter, or a constitutive promoter, such as any of the promoters described herein.

In any of these embodiments, a combination of engineered bacteria and engineered oncolytic virus can be used. In any of these embodiments, a combination of engineered bacteria and/or engineered oncolytic virus can be used in conjunction with conventional cancer therapies, such as surgery, chemotherapy, targeted therapies, radiation therapy, tomotherapy, immunotherapy, cancer vaccines, hormone therapy, hyperthermia, stem cell transplant (peripheral blood, bone marrow, and cord blood transplants), photodynamic therapy, therapy, and blood product donation and transfusion. In any of these embodiments, the engineered bacteria and/or engineered oncolytic virus can produce one or more cytotoxins or lytic peptides. In any of these embodiments, the engineered bacteria and/or engineer oncolytic virus can be used in conjunction with a cancer or tumor vaccine.

BRIEF DESCRIPTION OF THE FIGURES

FIG. 1A, FIG. 1B, FIG. 1C, FIG. 1D, FIG. 1E, FIG. 1F, FIG. 1G, FIG. 1H depict schematics of non-limiting examples of the disclosure in which a microorganism is genetically engineered to express gene sequence(s) encoding one or more immunomodulatory effectors or combinations of two or more these effectors. Such gene sequences include but are not limited to gene sequences for the production or catabolism of certain metabolites in the tumor microenvironment, and/or polypeptides for secretion or display on the microorganism cell surface, including but not limited to cytokines, antibodies, e.g., immune checkpoint inhibitors, and other anti-cancer molecules described herein. Such gene sequences can be located on a plasmid in the microorganism or can be integrated into the chromosome. In certain embodiments, the one or more gene sequences are under the control of inducible promoters known in the art or described herein. For example, such inducible promoters may be induced under low-oxygen conditions, such as an FNR promoter (depicted). In other embodiments, the promoters are induced in the presence of certain molecules or metabolites, e.g., in the presence of molecules or metabolites associated with the tumor microenvironment and/or with immune suppression. In some embodiments, the promoters are induced in certain tissue types. In some embodiments, promoters are induced in the presence of certain gut-specific molecules or metabolites. In some embodiments, the promoters are induced in the presence of some other metabolite that may or may not be present in the gut or the tumor, such as arabinose or another chemical or nutritional inducer known in the art or described herein. In certain embodiments, the one or more cassettes are under the control of constitutive promoters described herein or known in the art, e.g, whose expression can be fine-tuned using ribosome binding sites of different strengths. Such microorganisms optionally also comprise an auxotrophy, e.g., deltaThyA or deltaDapA.

FIG. 1A shows a schematic of a non-limiting example of the disclosure in which a microorganism is genetically engineered to express one or more gene sequence(s) for the expression of one or more enzymes for the degradation of kynurenine in the tumor microenvironment. The microorganism optionally also comprises one or more gene sequences for the expression of a transporter, which facilitates kynurenine uptake into the cell. The microorganism optionally also comprises an auxotrophy, e.g., deltaThyA or deltaDapA.

FIG. 1B shows a schematic of a non-limiting example of the disclosure in which a microorganism is genetically engineered to express one or more gene sequence(s) for the expression of one or more enzymes for the production of tryptophan in the tumor microenvironment. The microorganism optionally also comprises one or more gene sequences for the expression of a transporter, which facilitates kynurenine uptake into the cell, which in some examples is a substrate for tryptophan production. In some embodiments, the microorganism also comprises one of more gene sequences for the expression of one or more tryptophan exporters. The microorganism optionally also comprises an auxotrophy, e.g., deltaThyA or deltaDapA.

FIG. 1C shows a schematic of a non-limiting example of the disclosure in which a microorganism is genetically engineered to express one or more gene sequence(s) for the expression of one or more enzymes for the degradation of kynurenine and one or more enzyme for the production of tryptophan in the tumor microenvironment. The microorganism optionally also comprises one or more gene sequences for the expression of a transporter, which facilitates kynurenine uptake into the cell. In some embodiments, the microorganism also comprises one of more gene sequences for the expression of one or more tryptophan exporters. The microorganism optionally also comprises an auxotrophy, e.g., deltaThyA or deltaDapA.

FIG. 1D shows a schematic of a non-limiting example of the disclosure in which a microorganism is genetically engineered to express one or more gene sequence(s) for the expression of one or more enzymes for the degradation of adenosine in the tumor microenvironment. The microorganism optionally also comprises one or more gene sequences for the expression of a transporter, which facilitates adenosine uptake into the cell. The microorganism optionally also comprises an auxotrophy, e.g., deltaThyA or deltaDapA.

FIG. 1E shows a schematic of a non-limiting example of the disclosure in which a microorganism is genetically engineered to express one or more gene sequence(s) as described for FIG. 1D. In some embodiments, the microorganism can be administered in combination with one or more checkpoint inhibitors described herein, including but not limited to, an anti-PD1 and/or and anti-PD-L1 antibody.

FIG. 1F shows a schematic of a non-limiting example of the disclosure in which a microorganism is genetically engineered to express one or more gene sequence(s) for the expression of one or more enzymes for the degradation of adenosine in the tumor microenvironment. The microorganism optionally also comprises one or more gene sequences for the expression of a check point inhibitor, e.g., an anti-PD1 scFv, which can either be secreted from the microorganism or displayed (anchored) on the cell surface. The microorganism optionally also comprises an auxotrophy, e.g., deltaThyA or deltaDapA.

FIG. 1G shows a schematic of a non-limiting example of the disclosure in which a microorganism is genetically engineered to express one or more gene sequence(s) for the expression of one or more enzymes for the production of arginine in the tumor microenvironment. The microorganism optionally also comprises an auxotrophy, e.g., deltaThyA or deltaDapA.

FIG. 1H shows a schematic of a non-limiting example of the disclosure in which a microorganism is genetically engineered to express one or more gene sequence(s) for the expression of one or more enzymes for the production of arginine in the tumor microenvironment. The microorganism optionally also comprises an auxotrophy, e.g., deltaThyA or deltaDapA. In some embodiments, the microorganism can be administered in combination with one or more checkpoint inhibitors described herein, including but not limited to, an anti-PD1 and/or and anti-PD-L1 antibody.

FIG. 8A shows a schematic depicting an exemplary Tryptophan circuit. Tryptophan is produced from its precursor, chorismate, through expression of the trpE, trpG-D (also referred to as trpD), trpC-F (also referred to as trpC), trpB and trpA genes. Optional knockout of the tryptophan repressor trpR is also depicted. Optional production of chorismate through expression of aroG/F/H and aroB, aroD, aroE, aroK and aroC genes is also shown. The bacteria may optionally also include gene sequence(s) for the expression of YddG, which functions as a tryptophan exporter. The bacteria may optionally also comprise one or more gene sequence(s) depicted or described in FIG. 8B, and/or FIG. 8C, and/or FIG. 8D. FIG. 8B depicts a tryptophan producing strain, in which tryptophan is produced from the chorismate precursor through expression of the trpE, trpG-D, trpC-F, trpB and trpA genes. AroG and TrpE are replaced with feedback resistant versions to improve tryptophan production. Optionally, bacteria may comprise any of the transporters and/or additional tryptophan circuits depicted in FIG. 8A and/or described in the description of FIG. 8A. The bacteria may optionally also comprise one or more gene sequence(s) depicted or described in FIG. 8C, and/or FIG. 8D. Optionally, trpR and/or the tnaA gene (encoding a tryptophanase converting tryptophan into indole) are deleted to further increase levels of tryptophan produced. FIG. 8C depicts a tryptophan producing strain, in which tryptophan is produced from the chorismate precursor through expression of the trpE, trpG-D, trpC-F, trpB and trpA genes. AroG and TrpE are replaced with feedback resistant versions to improve tryptophan production. The strain further comprises either a wild type or a feedback resistant SerA gene. *Escherichia coli* serA-encoded 3-phosphoglycerate (3PG) dehydrogenase catalyzes the first step of the major phosphorylated pathway of L-serine (Ser) biosynthesis. This step is an oxidation of 3PG to 3-phosphohydroxypyruvate (3PHP) with the concomitant reduction of NAD1 to NADH. *E. coli* uses one serine for each tryptophan produced. As a result, by expressing serA, tryptophan production is improved. Optionally, bacteria may comprise any of the transporters and/or additional tryptophan circuits depicted in FIG. 8A and/or described in the description of FIG. 8A. The bacteria may optionally also comprise one or more gene sequence(s) depicted or described in FIG. 8B, and/or FIG. 8D. Optionally, Trp Repressor and/or the tnaA gene are deleted to further increase levels of tryptophan produced. The bacteria may optionally also include gene sequence(s) for the expression of YddG, which functions as a tryptophan exporter. FIG. 8D depicts a non-limiting example of a tryptophan producing strain, in which tryptophan is produced from the chorismate precursor through expression of the trpE, trpG-D, trpC-F, trpB and trpA genes. AroG and TrpE are replaced with feedback resistant versions to improve tryptophan production. The strain further optionally comprises either a wild type or a feedback resistant SerA gene. Optionally, bacteria may comprise any of the transporters and/or additional tryptophan circuits depicted in FIG. 8A and/or described in the description of FIG. 8A. The bacteria may optionally also comprise one or more gene sequence(s) depicted or described in FIG. 8B, and/or FIG. 8C. Optionally, Trp Repressor and/or the tnaA gene are deleted to further increase levels of tryptophan produced. The bacteria may optionally also include gene sequence(s) for the expression of YddG, which functions as a tryptophan exporter. Optionally, the bacteria may also comprise a deletion in PheA, which prevents conversion of chorismate into phenylalanine and thereby promotes the production of anthranilate and tryptophan.

FIG. 10A depicts a bar graph showing tryptophan production by various tryptophan producing strains. The data show expressing a feedback resistant form of AroG (Aro$^{fbr}$) is necessary to get tryptophan production. Additionally, using a feedback resistant trpE (trpE$^{fbr}$) has a positive effect on tryptophan production. FIG. 10B shows tryptophan production from a strain comprising a tet-trpE$^{fbr}$DCBA, tet-aro$^{fbr}$ construct, comparing glucose and glucuronate as carbon sources in the presence and absence of oxygen. It takes *E. coli* two molecules of phosphoenolpyruvate (PEP) to produce one molecule of tryptophan. When glucose is used as the carbon source, 50% of all available PEP is used to import glucose into the cell through the PTS system (Phosphotransferase system). Tryptophan production is improved by using a non-PTS sugar (glucuronate) aerobically. The data also show the positive effect of deleting tnaA (only at early time point aerobically). FIG. 10C depicts a bar graph showing improved tryptophan production by engineered strain comprising ΔtrpRΔtnaA, tet-trpE$^{fbr}$DCBA, tet-aroG$^{fbr}$ through the addition of serine. FIG. 10D depicts a bar graph showing a comparison in tryptophan production in strains SYN2126, SYN2323, SYN2339, SYN2473, and SYN2476. SYN2126 ΔtrpRΔtnaA. ΔtrpRΔtnaA, tet-aroGfbr. SYN2339 comprises ΔtrpRΔtnaA, tet-aroGfbr, tet-trpEfbrDCBA. SYN2473 comprises ΔtrpRΔtnaA, tet-aroGfbr-serA, tet-trpEfbrDCBA. SYN2476 comprises ΔtrpRΔtnaA, tet-trpEfbrDCBA. Results indicate that expressing aroG is not sufficient nor necessary under these conditions to get Trp production and that expressing serA is beneficial for tryptophan production.

FIG. 11A depicts a schematic showing intermediates in tryptophan biosynthesis and the gene products catalyzing the production of these intermediates. Phosphoenolpyruvate (PEP) and D-erythrose 4-phosphate (E4P) are used to generate 3-deoxy-D-arabino-heptulosonate 7-phosphate (DAHP). DHAP is catabolized to chorismate and then anthranilate, which is converted to tryptophan (Trp) by the tryptophan operon. Alternatively, chorismate can be used in the synthesis of tyrosine (Tyr) and/or phenylalanine (Phe). In the serine biosynthesis pathway, D-3-phosphoglycerate is converted to serine, which can also be a source for tryptophan biosynthesis. AroG, AroF, AroH: DAHP synthase catalyzes an aldol reaction between phosphoenolpyruvate and D-erythrose 4-phosphate to generate 3-deoxy-D-arabino-heptulosonate 7-phosphate (DAHP). There are three isozymes of DAHP synthase, each specifically feedback regulated by tyrosine (AroF), phenylalanine (AroG) or tryptophan (AroH). AroB: Dehydroquinate synthase (DHQ synthase) is involved in the second step of the chorismate pathway, which leads to the biosynthesis of aromatic amino acids. DHQ synthase catalyzes the cyclization of 3-deoxy-D-arabino-heptulosonic acid 7-phosphate (DAHP) to dehydroquinate (DHQ). AroD: 3-Dehydroquinate dehydratase (DHQ dehydratase) is involved in the 3rd step of the chorismate pathway, which leads to the biosynthesis of aromatic amino acids. DHQ dehydratase catalyzes the conversion of DHQ to 3-dehydroshikimate and introduces the first double bond of the aromatic ring. AroE, YdiB: E. coli expresses two shikimate dehydrogenase paralogs, AroE and YdiB. Shikimate dehydrogenase is involved in the 4th step of the chorismate pathway, which leads to the biosynthesis of aromatic amino acids. This enzyme converts 3-dehydroshikimate to shikimate by catalyzing the NADPH linked reduction of 3-dehydro-shikimate. AroL/AroK: Shikimate kinase is involved in the fifth step of the chorismate pathway, which leads to the biosynthesis of aromatic amino acids. Shikimate kinase catalyzes the formation of shikimate 3-phosphate from shikimate and ATP. There are two shikimate kinase enzymes, I (AroK) and II (AroL). AroA: 3-Phosphoshikimate-1-carboxyvinyltransferase (EPSP synthase) is involved in the 6th step of the chorismate pathway, which leads to the biosynthesis of aromatic amino acids. EPSP synthase catalyzes the transfer of the enolpyruvoyl moiety from phosphoenolpyruvate to the hydroxyl group of carbon 5 of shikimate 3-phosphate with the elimination of phosphate to produce 5-enolpyruvoyl shikimate 3-phosphate (EPSP). AroC: Chorismate synthase (AroC) is involved in the 7th and last step of the chorismate pathway, which leads to the biosynthesis of aromatic amino acids. This enzyme catalyzes the conversion of 5-enolpyruvylshikimate 3-phosphate into chorismate, which is the branch point compound that serves as the starting substrate for the three terminal pathways of aromatic amino acid biosynthesis. This reaction introduces a second double bond into the aromatic ring system. TrpEDCAB (E coli trp operon): TrpE (anthranilate synthase) converts chorismate and L-glutamine into anthranilate, pyruvate and L-glutamate. Anthranilate phosphoribosyl transferase (TrpD) catalyzes the second step in the pathway of tryptophan biosynthesis. TrpD catalyzes a phosphoribosyltransferase reaction that generates N-(5'-phosphoribosyl)-anthranilate. The phosphoribosyl transferase and anthranilate synthase contributing portions of TrpD are present in different portions of the protein. Bifunctional phosphoribosylanthranilate isomerase/indole-3-glycerol phosphate synthase (TrpC) carries out the third and fourth steps in the tryptophan biosynthesis pathway. The phosphoribosylanthranilate isomerase activity of TrpC catalyzes the Amadori rearrangement of its substrate into carboxyphenylaminodeoxyribulose phosphate. The indole-glycerol phosphate synthase activity of TrpC catalyzes the ring closure of this product to yield indole-3-glycerol phosphate. The TrpA polypeptide (TSase α) functions as the α subunit of the tetrameric (α2-β2) tryptophan synthase complex. The TrpB polypeptide functions as the β subunit of the complex, which catalyzes the synthesis of L-tryptophan from indole and L-serine, also termed the β reaction. TnaA: Tryptophanase or tryptophan indole-lyase (TnaA) is a pyridoxal phosphate (PLP)-dependent enzyme that catalyzes the cleavage of L-tryptophan to indole, pyruvate and NH4+. PheA: Bifunctional chorismate mutase/prephenate dehydratase (PheA) carries out the shared first step in the parallel biosynthetic pathways for the aromatic amino acids tyrosine and phenylalanine, as well as the second step in phenylalanine biosynthesis. TyrA: Bifunctional chorismate mutase/prephenate dehydrogenase (TyrA) carries out the shared first step in the parallel biosynthetic pathways for the aromatic amino acids tyrosine and phenylalanine, as well as the second step in tyrosine biosynthesis. TyrB, ilvE, AspC: Tyrosine aminotransferase (TyrB), also known as aromatic-amino acid aminotransferase, is a broad-specificity enzyme that catalyzes the final step in tyrosine, leucine, and phenylalanine biosynthesis. TyrB catalyzes the transamination of 2-ketoisocaproate, p-hydroxyphenylpyruvate, and phenylpyruvate to yield leucine, tyrosine, and phenylalanine, respectively. TyrB overlaps with the catalytic activities of branched-chain amino-acid aminotransferase (IlvE), which also produces leucine, and aspartate aminotransferase, PLP-dependent (AspC), which also produces phenylalanine. SerA: D-3-phosphoglycerate dehydrogenase catalyzes the first committed step in the biosynthesis of L-serine. SerC: The serC-encoded enzyme, phosphoserine/phosphohydroxythreonine aminotransferase, functions in the biosynthesis of both serine and pyridoxine, by using different substrates. Pyridoxal 5'-phosphate is a cofactor for both enzyme activities. SerB: Phosphoserine phosphatase catalyzes the last step in serine biosynthesis. Steps which are negatively regulated by the Trp Repressor (2), Tyr Repressor (1), or tyrosine (3), phenylalanine (4), or tryptophan (4) or positively regulated by tryptophan (6) are indicated. FIG. 11B depicts a schematic showing exemplary engineering strategies which can improve tryptophan production. Each of these exemplary strategies can be used alone or two or more strategies can be combined to increase tryptophan production. Intervention points are in bold, italics and underlined. In one embodiment of the disclosure, bacteria are engineered to express a feedback resistant from of AroG (AroGfbr). In one embodiment, bacteria are engineered to express AroL. In one embodiment, bacteria are engineered to comprise one or more copies of a feedback resistant form of TrpE (TrpEfbr). In one embodiment, bacteria are engineered to comprise one or more additional copies of the Trp operon, e.g., TrpE, e.g. TrpEfbr, and/or TrpD, and/or TrpC, and/or TrpA, and/or TrpB. In one embodiment, endogenous TnaA is knocked out through mutation(s) and/or deletion(s). In one embodiment, bacteria are engineered to comprise one or more additional copies of SerA. In one embodiment, bacteria are engineered to comprise one or more additional copies of YddG, a tryptophan exporter. In one embodiment, endogenous PheA is knocked out through mutation(s) and/or deletion(s). In one embodiment, bacteria are engineered to comprise a circuit for the expression of kynureninase, e.g., kynureninase from *Pseudomonas fluorescens* or human kynureninase, Without wishing to be bound by theory, addition of a circuit expressing kynureninase will increase production of tryptophan if kynurenine is present in the extracellular environment, such as for example a tumor microenvironment. A strain comprising circuitry to enhance tryptophan production and circuitry for the consumption of kynurenine reduces kynurenine levels while increasing tryptophan levels, e.g., in the extracellular environment, such as a tumor microenvironment, thereby more effectively changing the tryptophan to kynurenine ratio. In one embodiment, two or more of the strategies depicted in the schematic of FIG. 11B are engineered into a bacterial strain. Alternatively, other gene products in this pathway may be mutated or overexpressed.

Figure 18A:
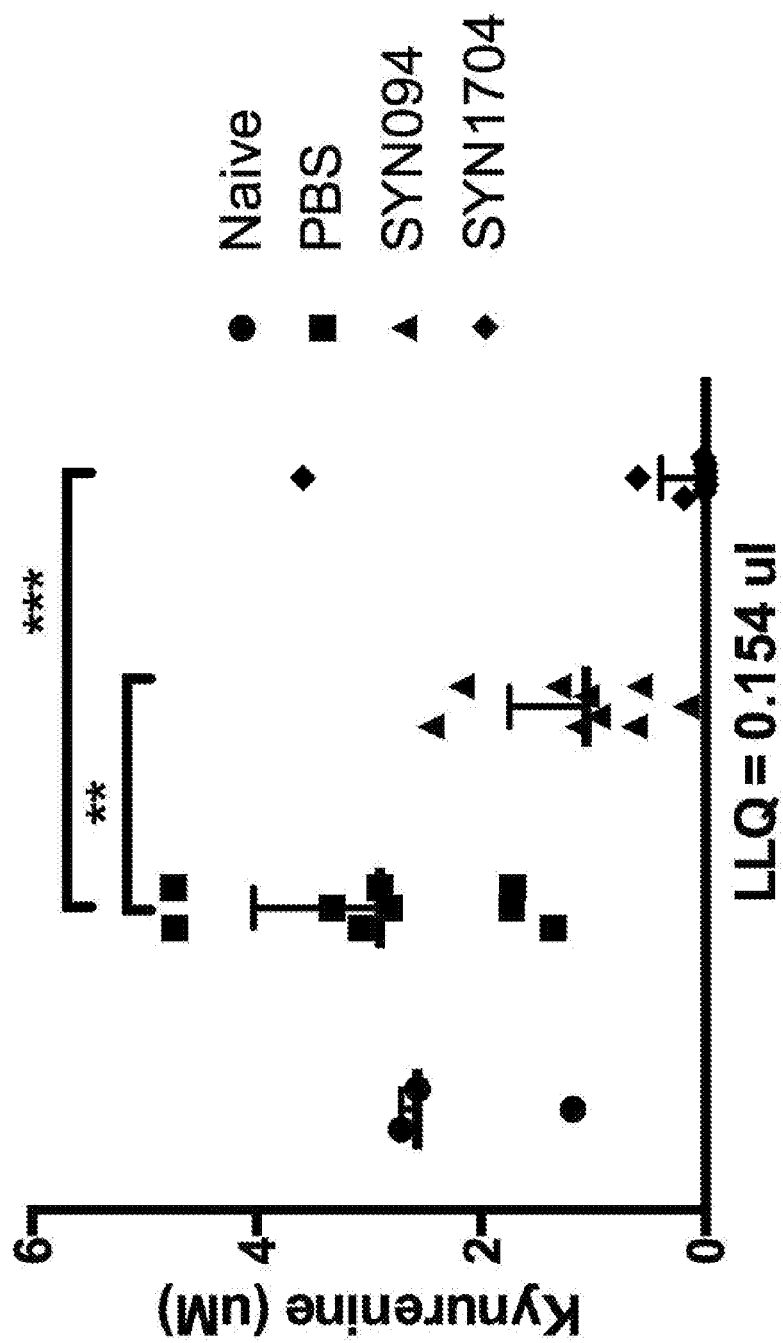
Figure 18B:
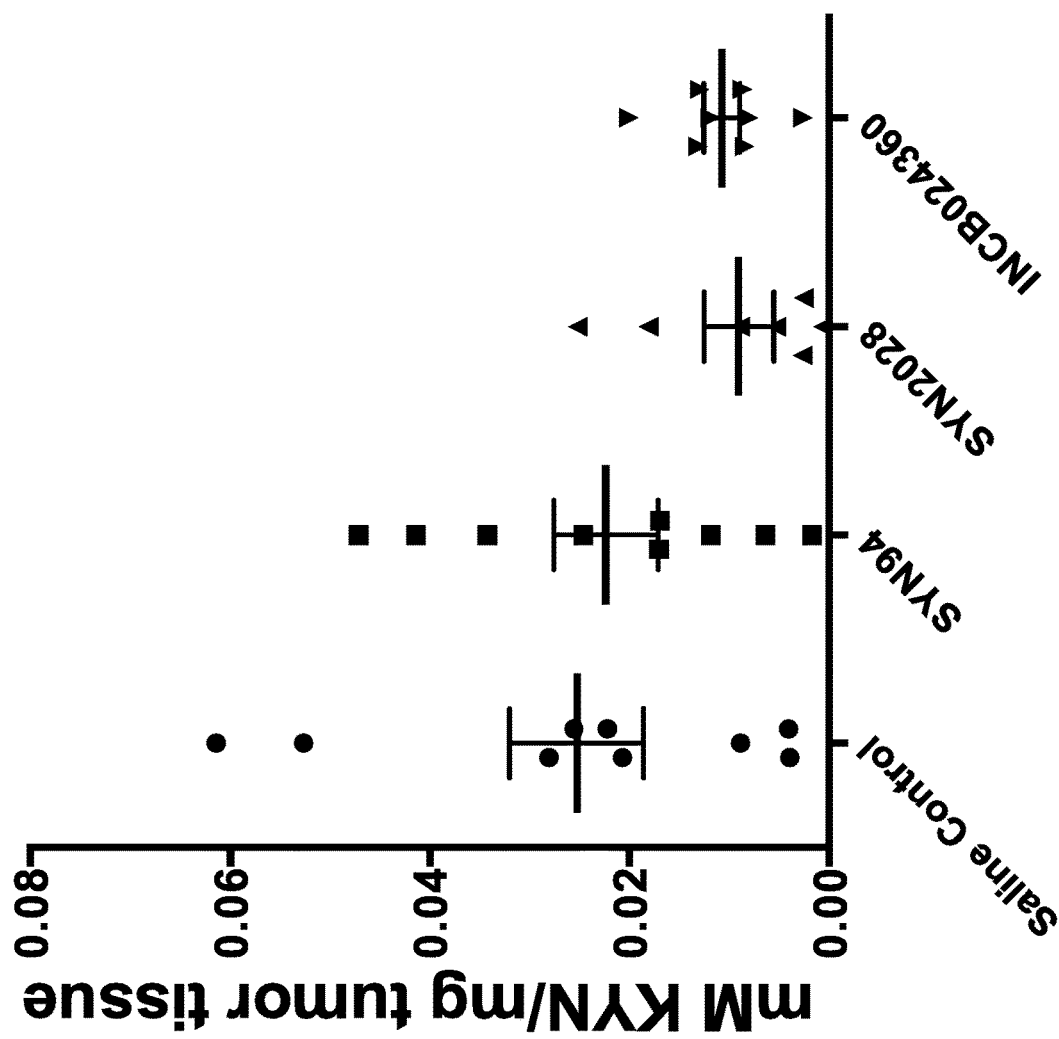

FIG. 18A and FIG. 18B depict dot plots showing intra-tumoral kynurenine depletion by strains producing kynureninase from Pseudomonas fluorescens. FIG. 18A depicts a dot plot showing a intra tumor concentrations observed for the kynurenine consuming strain SYN1704, carrying a constitutively expressed Pseudomonase fluorescens kynureninase on a medium copy plasmid. FIG. 18B. depicts a dot plot showing a intra tumor concentrations observed for the kynurenine consuming strain SYN2028 carrying a constitutively expressed chromosomally integrated copy of Pseudomonase fluorescens kynureninase. The IDO inhibitor INCB024360 is used as a positive control.

Figure 19:
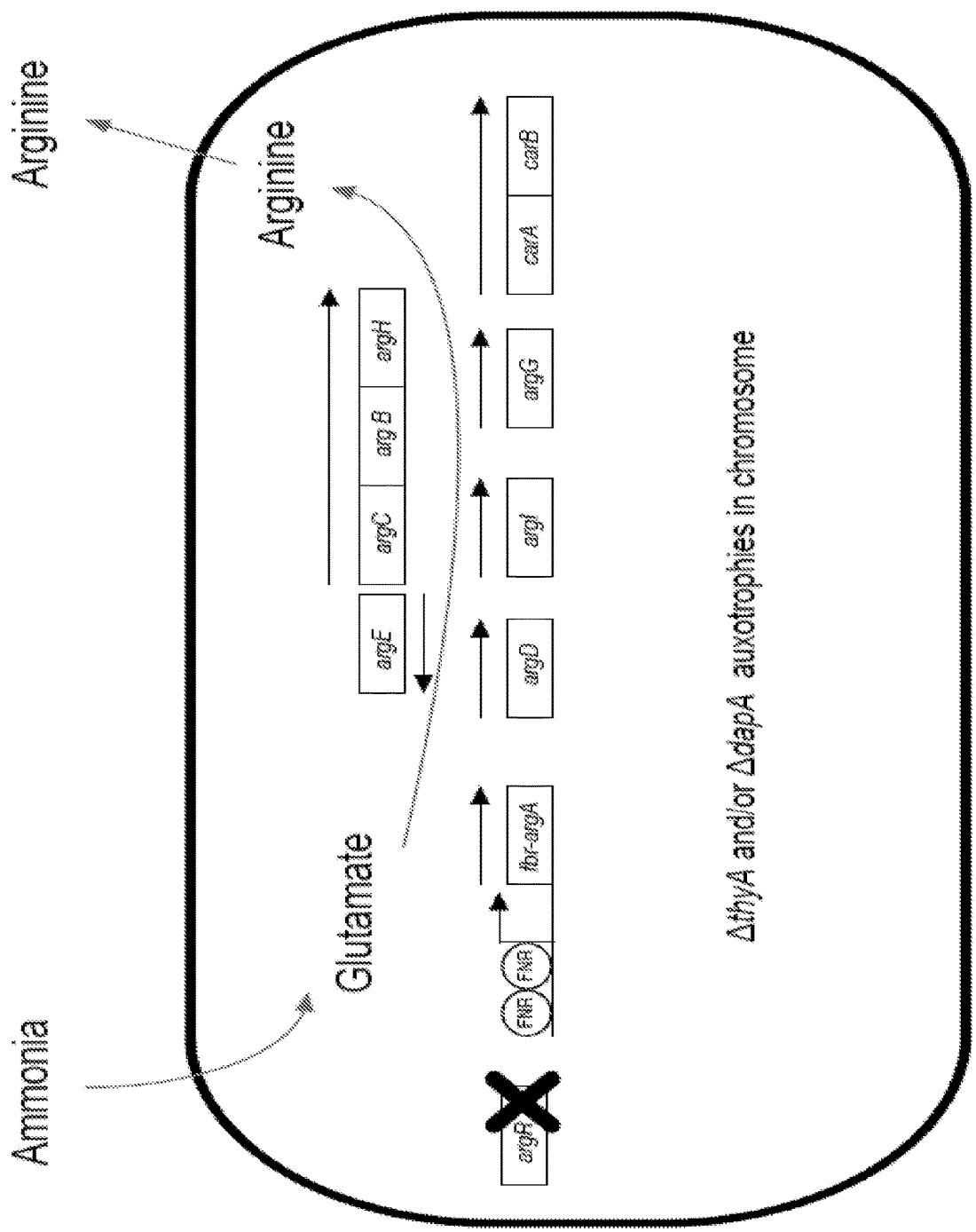

FIG. 19 depicts an exemplary embodiment of an engineered bacterial strain deleted for the argR gene and expressing the feedback-resistant argA$^{fbr}$ gene. This strain further comprises one or more auxotrophic modifications on the chromosome. This strain is useful for the production of arginine.

Figure 20:
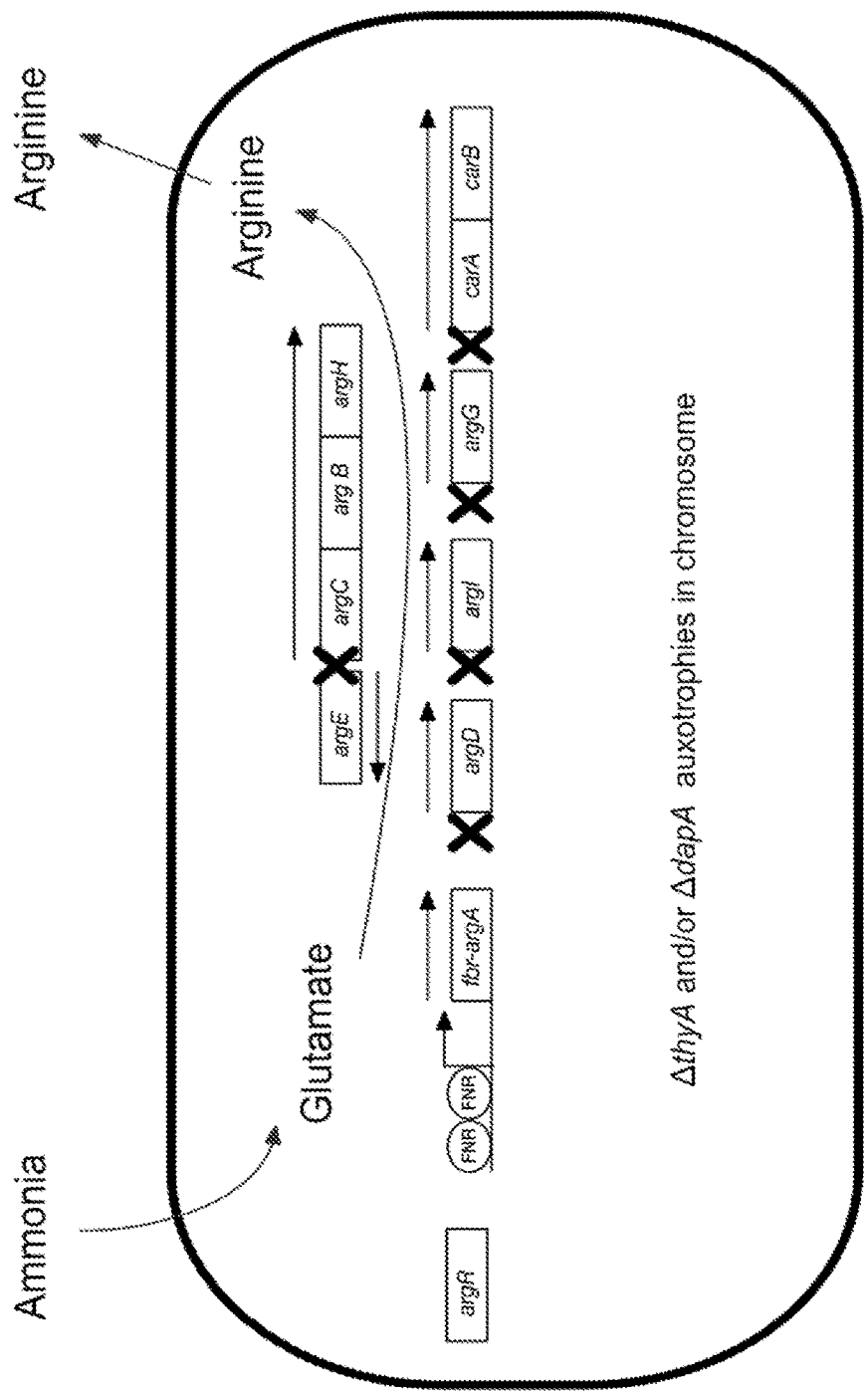

FIG. 20 depicts an exemplary embodiment of an engineered bacterial strain, which lacks ArgR binding sites and expresses the feedback-resistant argA$^{fbr}$ gene. This strain further comprises one or more auxotrophic modifications on the chromosome. This strain is useful for the production of arginine.

Figure 21:
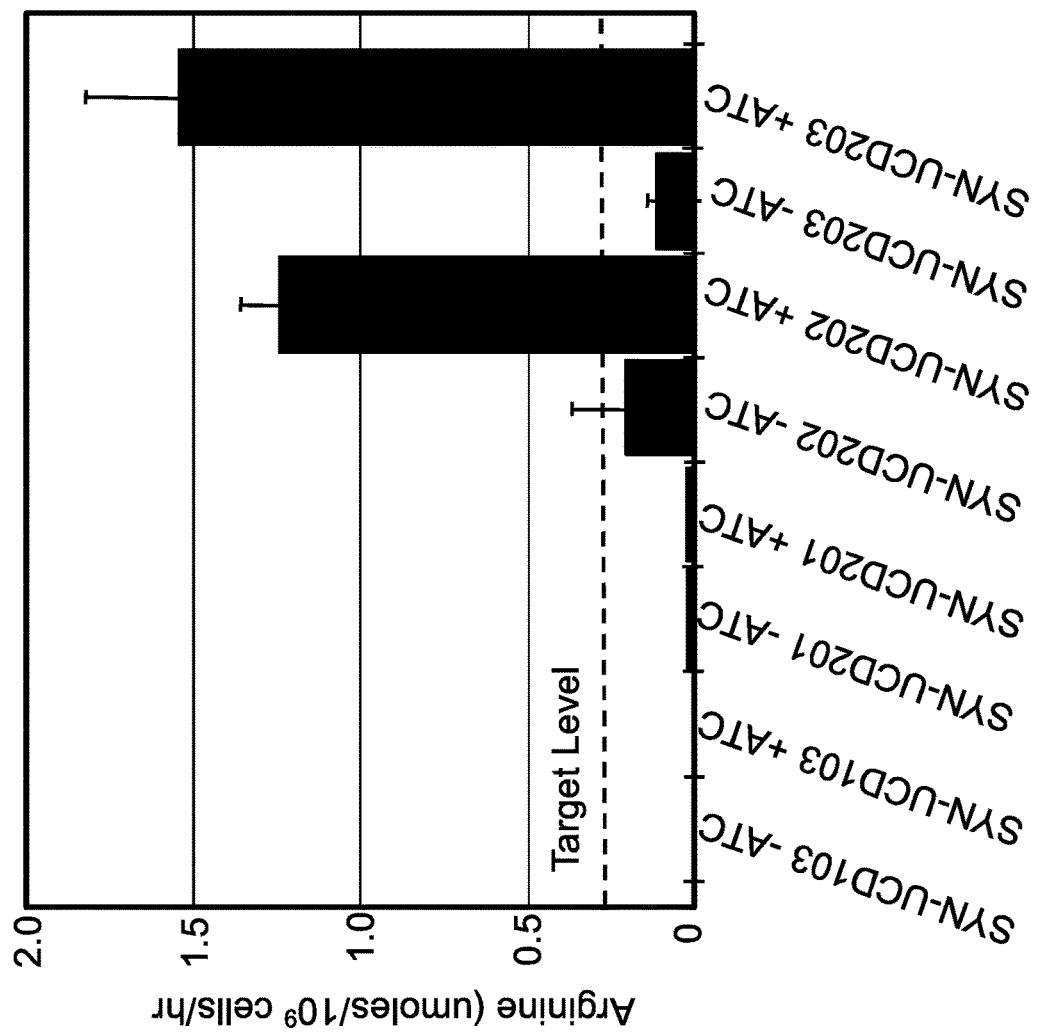

FIG. 21 depicts a bar graph of in vitro arginine levels produced by streptomycin-resistant control Nissle (SYN-UCD103), SYN-UCD201, SYN-UCD202, and SYN-UCD203 under inducing (+ATC) and non-inducing (−ATC) conditions. SYN-UCD201 comprises ΔArgR and no argA$^{fbr}$. SYN-UCD202 comprises ΔArgR and tetracycline-inducible argA$^{fbr}$ on a high-copy plasmid. SYN-UCD203 comprises ΔArgR and tetracycline-driven argA$^{fbr}$ on a low-copy plasmid.

Figure 22:
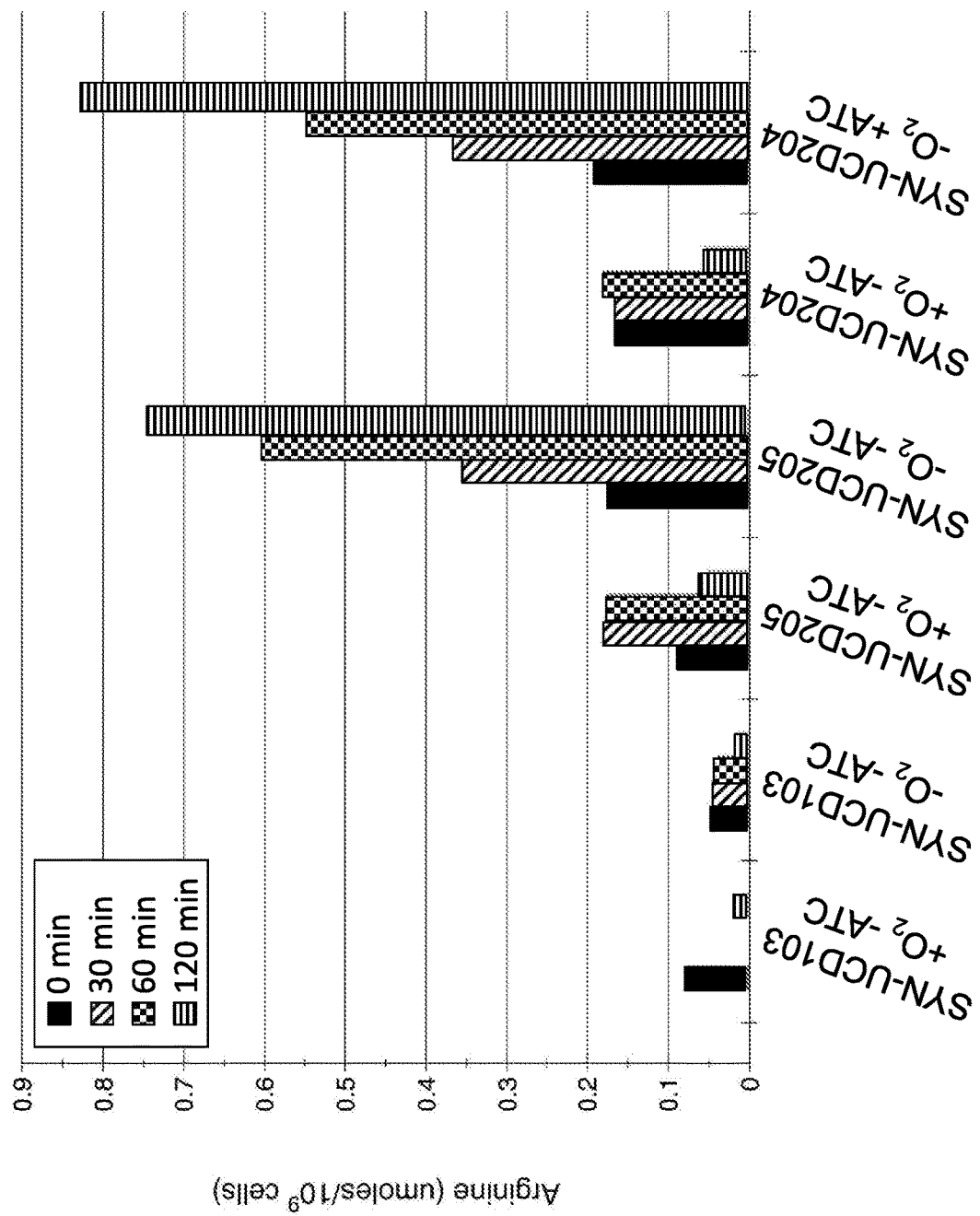

FIG. 22 depicts a bar graph of in vitro arginine levels produced by streptomycin-resistant Nissle (SYN-UCD103), SYN-UCD205, and SYN-UCD204 under inducing (+ATC) and non-inducing (−ATC) conditions, in the presence (+O$_2$) or absence (—O$_2$) of oxygen. SYN-UCD103 is a control Nissle construct. SYN-UCD205 comprises ΔArgR and argA$^{fbr}$ expressed under the control of a FNR-inducible promoter on a low-copy plasmid. SYN204 comprises ΔArgR and argA$^{fbr}$ expressed under the control of a tetracycline-inducible promoter on a low-copy plasmid.

Figure 23A:
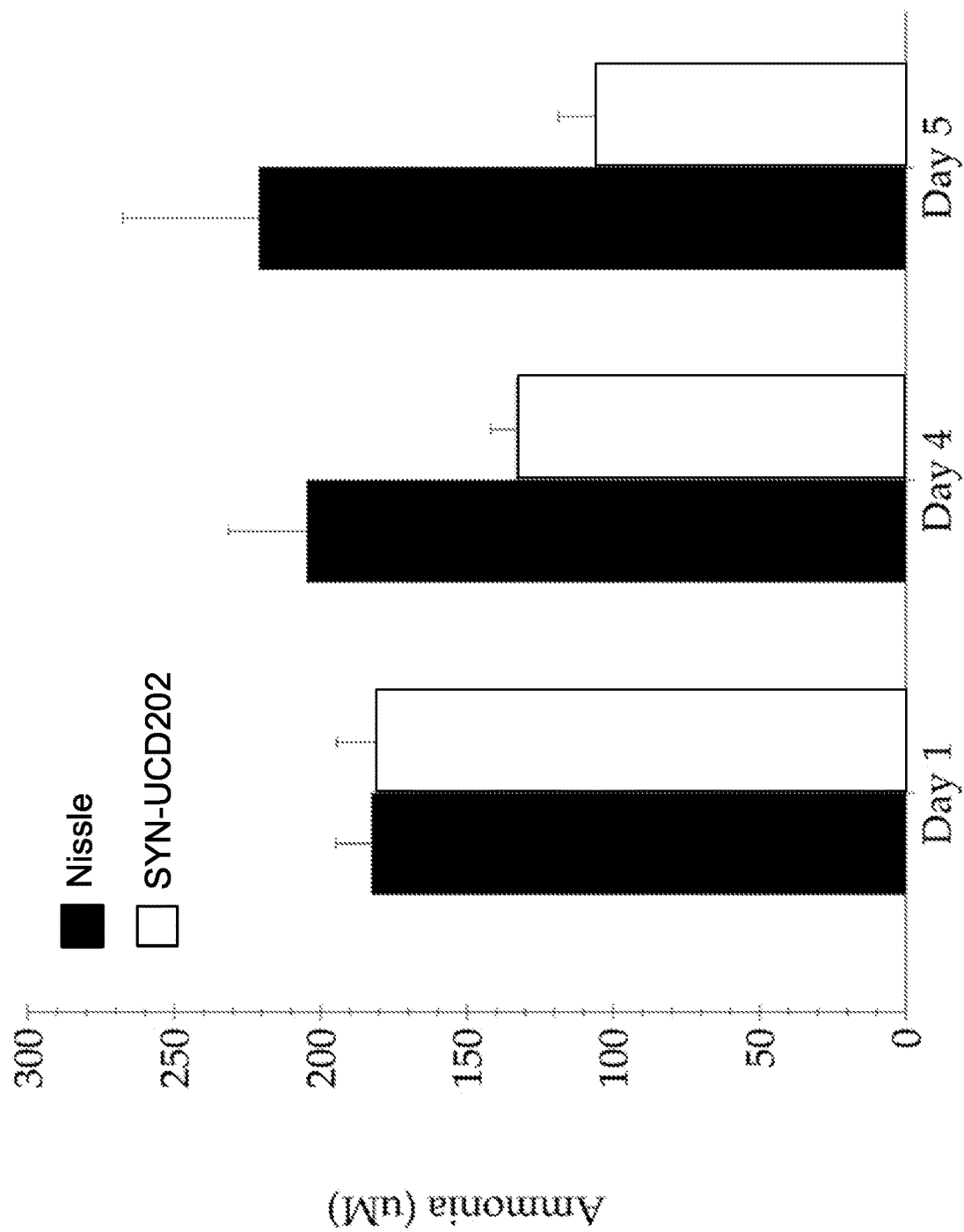
Figure 23B:
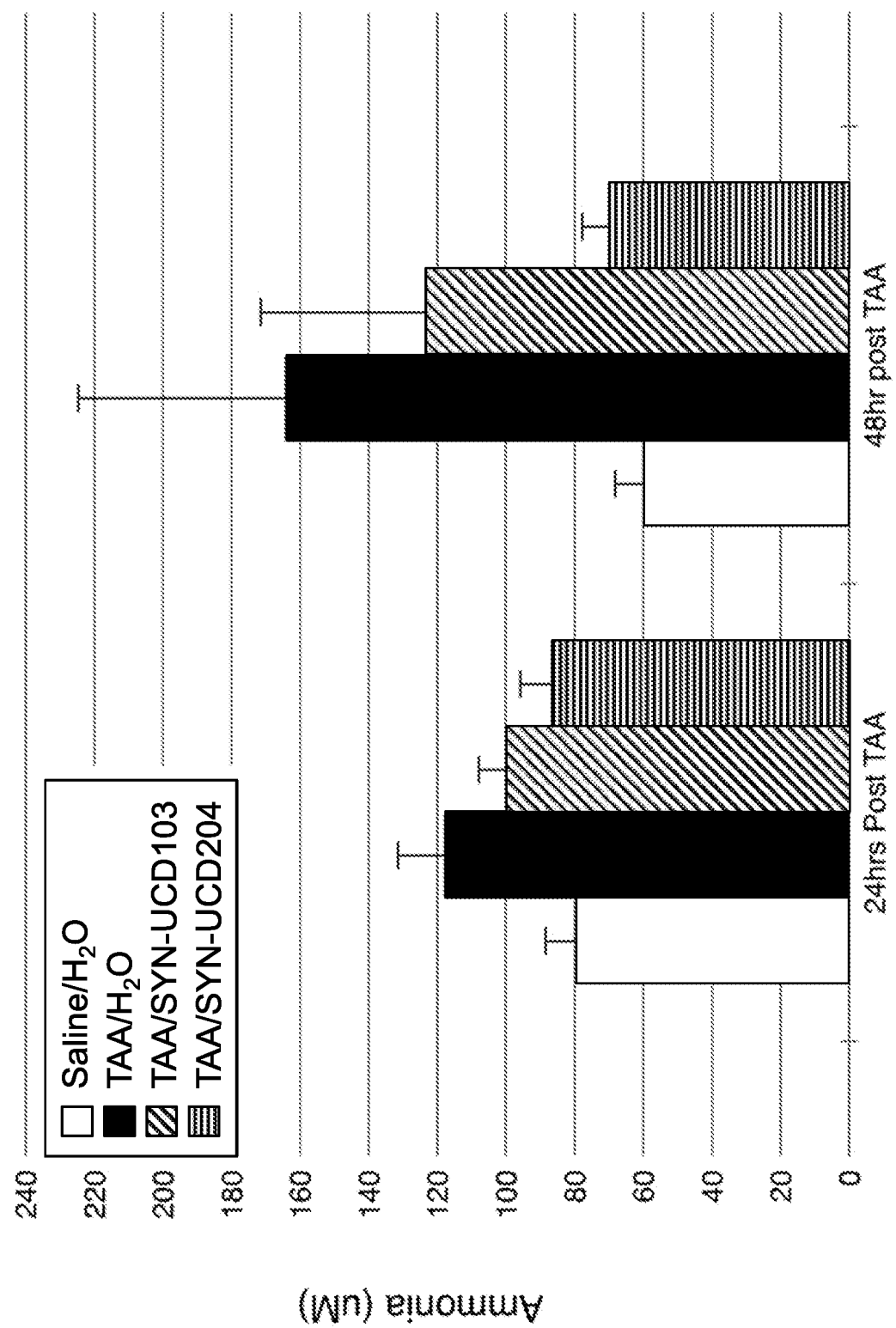
Figure 23C:
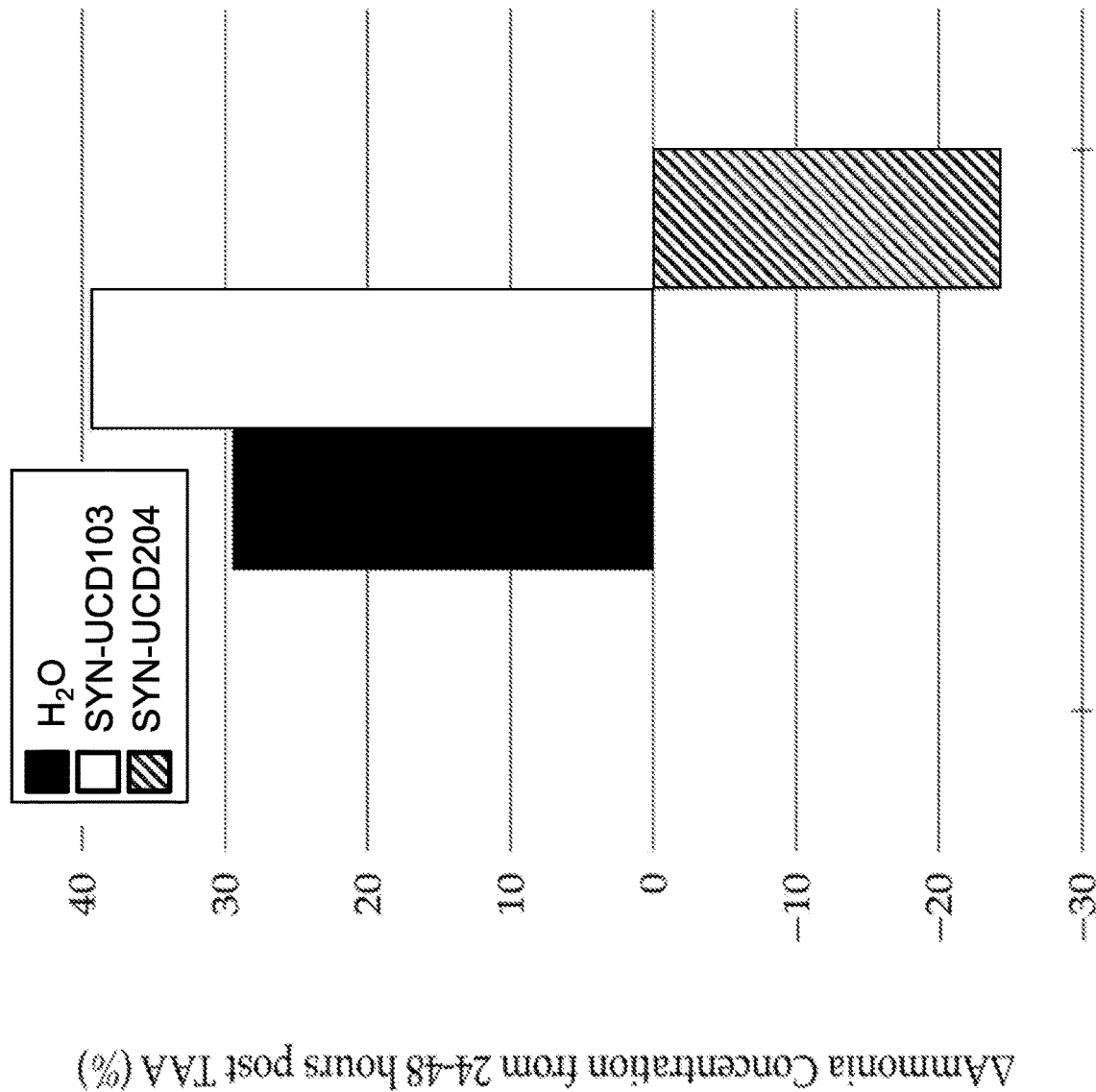

FIG. 23A, FIG. 23B, and FIG. 23C depict bar graphs of ammonia levels in hyperammonemic TAA mice. FIG. 23A depicts a bar graph of ammonia levels in hyperammonemic mice treated with unmodified control Nissle or SYN-UCD202, a genetically engineered strain in which the Arg repressor gene is deleted and the argA$^{fbr}$ gene is under the control of a tetracycline-inducible promoter on a high-copy plasmid. A total of 96 mice were tested, and the error bars represent standard error. Blood ammonia (BA) levels in mice treated with SYN-UCD202 are lower than ammonia levels in mice treated with unmodified control Nissle at day 4 and day 5 (Nissle, BA=220 mM; SYN-UCD202, BA=105 mM; BA$_{Nissle}$−BA$_{SYN-UCD202}$=115 mM; average blood volume=1.5 mL. FIG. 23B depicts a bar graph showing in vivo efficacy (ammonia consumption) of SYN-UCD204 in the TAA mouse model, relative to streptomycin-resistant control Nissle (SYN-UCD103) and vehicle-only controls.

FIG. 23C depicts a bar graph of the percent change in blood ammonia concentration between 24-48 hours post-TAA treatment.

Figure 24:
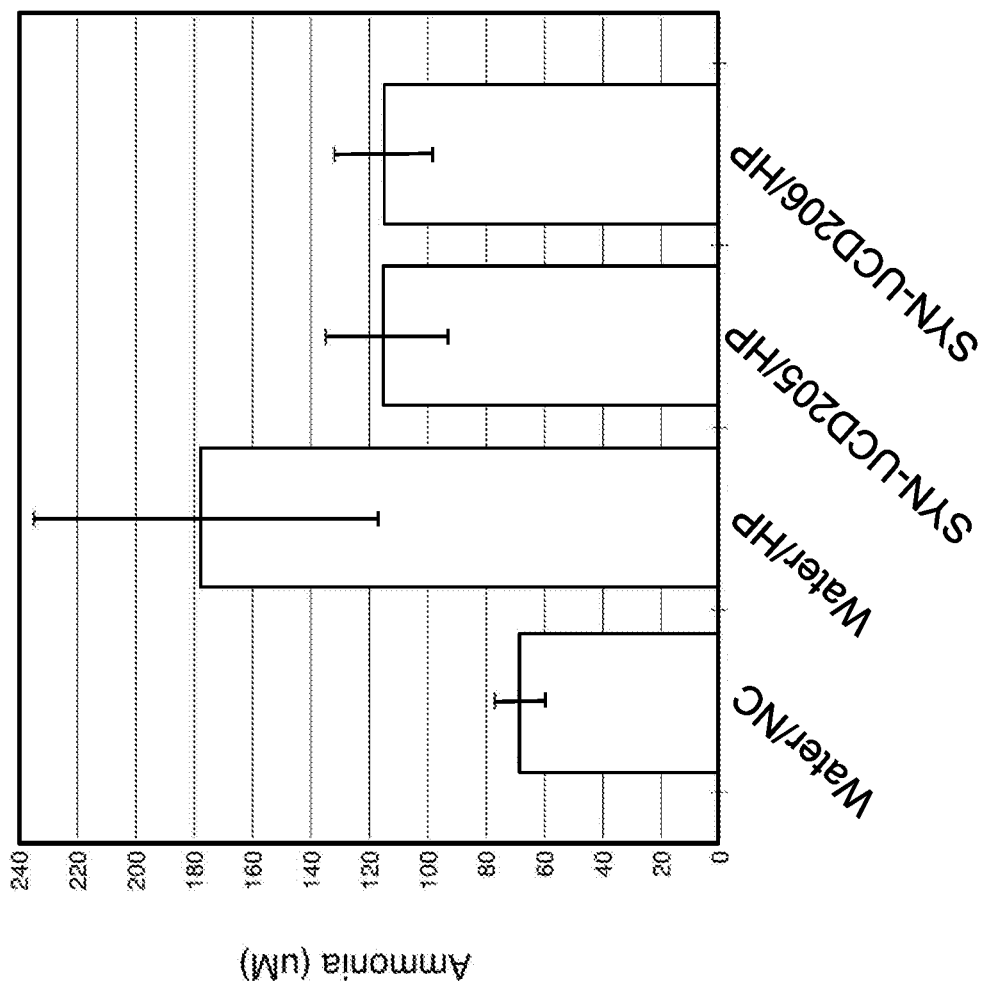

FIG. 24 depicts a bar graph of ammonia levels in hyperammonemic spf$^{ash}$ mice on a high protein diet. Mice were treated with SYN-UCD204 (comprising ΔArgR, PfnrS-ArgAfbr on a low-copy plasmid and wild type ThyA), SYN-UCD206 (comprising ΔArgR, PfnrS-ArgAfbr on a low-copy plasmid and ΔThyA) or water, then switched to high protein chow after 2 days. As seen in FIG. 24, at 48 hours after switch to high protein chow ammonia levels were reduced to a similar extent in both SYN-UCD205 and SYN-UCD206, indicating that ThyA auxotrophy does not have a significant effect on efficacy.

Figure 25A:
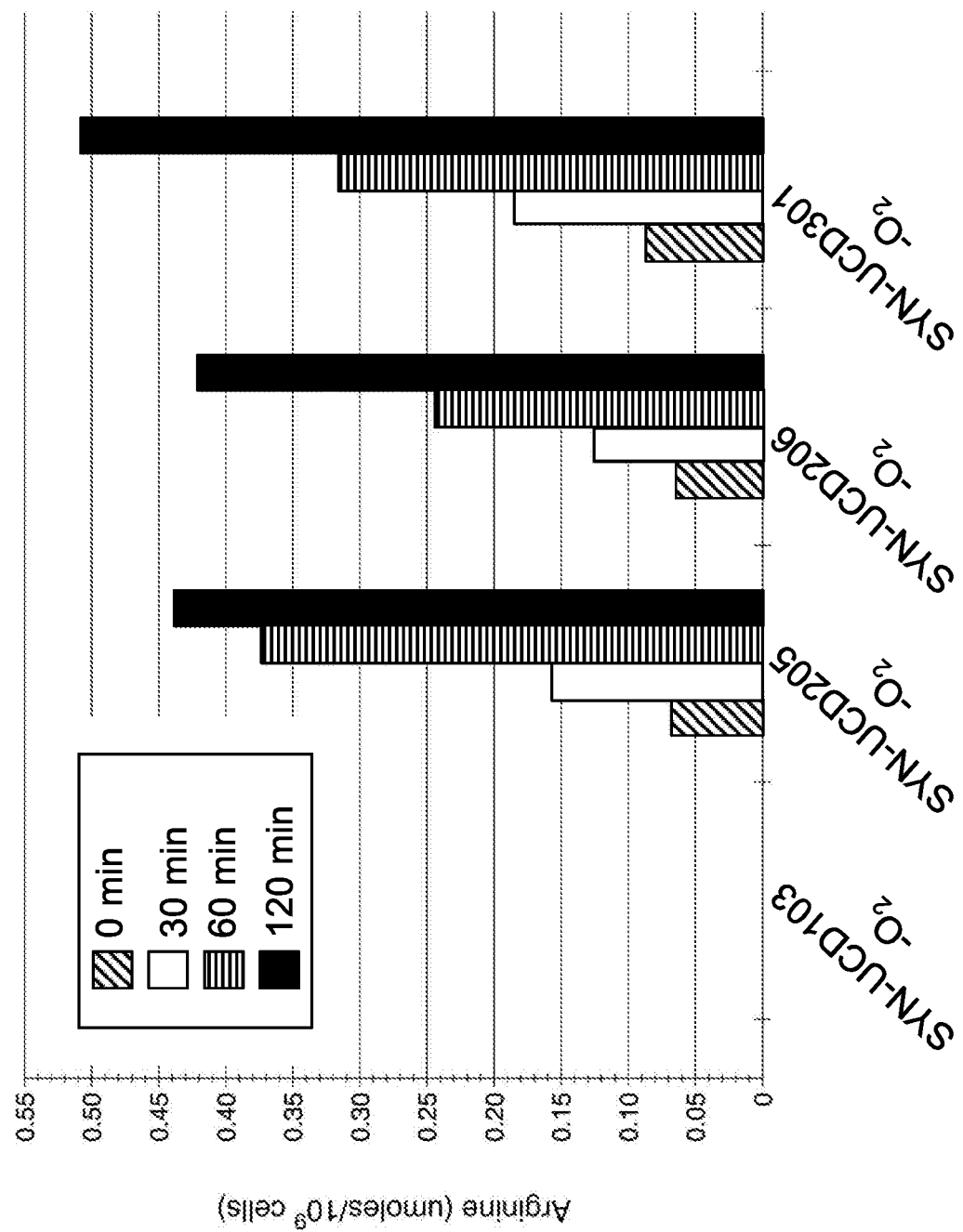
Figure 25B:
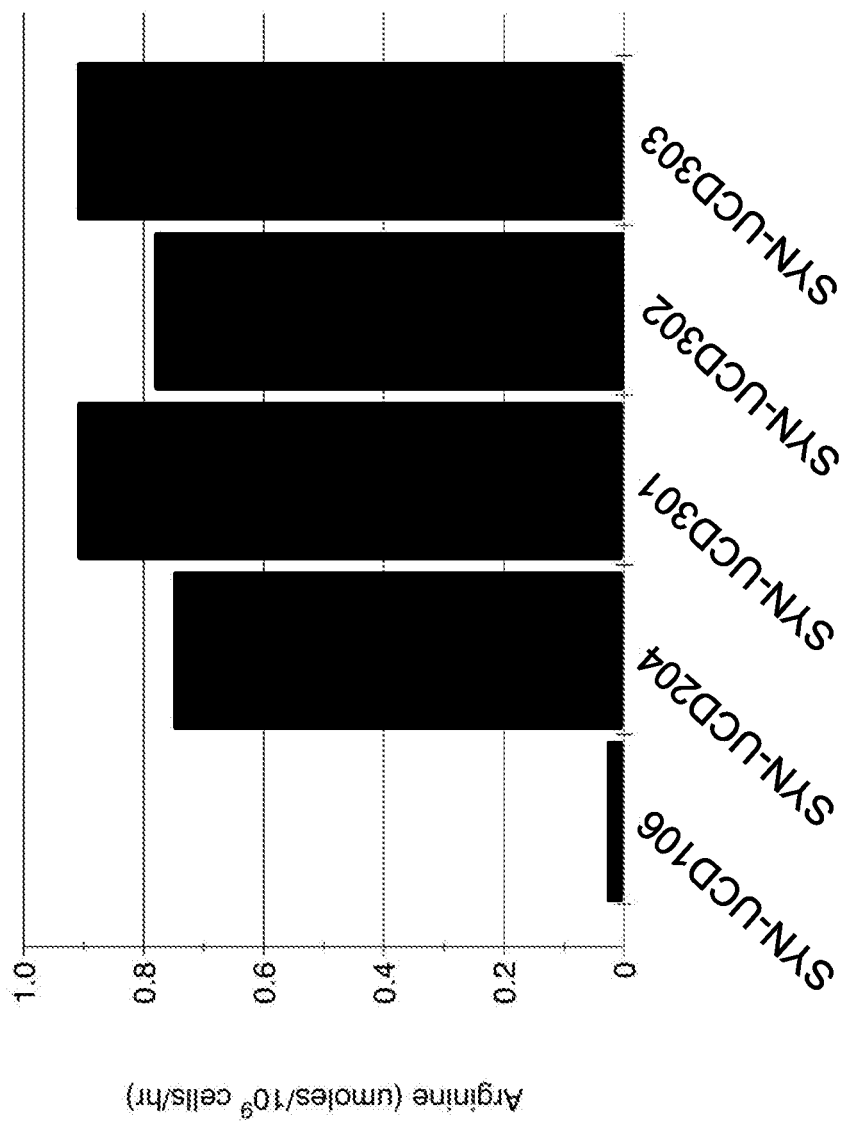
Figure 25C:
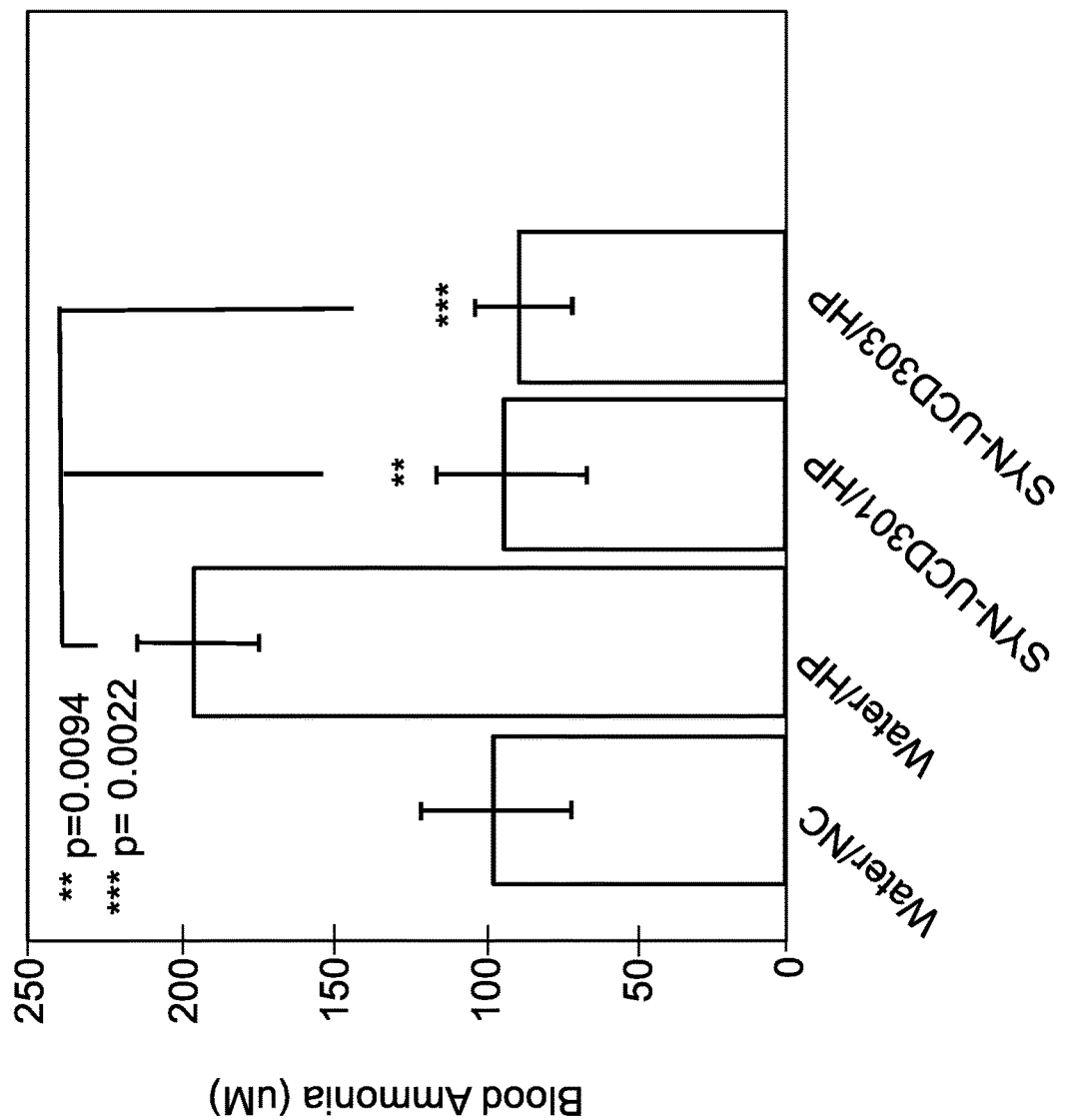

FIG. 25A, FIG. 25B, and FIG. 25C depict bar graphs of ammonia levels in the media at various time points post anaerobic induction. FIG. 25A depicts a bar graph of the levels of arginine production of SYN-UCD205, SYN-UCD206, and SYN-UCD301 measured at 0, 30, 60, and 120 minutes. FIG. 25B depicts a bar graph of the levels of arginine production of SYN-UCD204 (comprising ΔArgR, PfnrS-ArgAfbr on a low-copy plasmid and wild type ThyA), SYN-UCD301, SYN-UCD302, and SYN-UCD303 (all three of which comprise an integrated FNR-ArgAfbr construct; SYN UCD301 comprises ΔArgR, and wtThyA; SYN 303 comprises ΔArgR, and ΔThyA). Results indicate that chromosomal integration of FNR ArgA fbr results in similar levels of arginine production as seen with the low copy plasmid strains expressing the same construct. FIG. 25C depicts a bar graph of ammonia levels in hyperammonemic spf$^{ash}$ mice on a normal (NC) or high protein (HP) diet. Ammonia levels of spf-ash mice in a high protein diet were reduced in the SYN-UCD301 and SYN-UCD303 groups as compared to the H$_2$O high protein diet control group. The observed reduction in ammonia levels was similar in both SYN-UCD301 and SYN-UCD303, indicating that ThyA auxotrophy does not have a significant effect on efficacy of SYN-UCD303.

Figure 26:
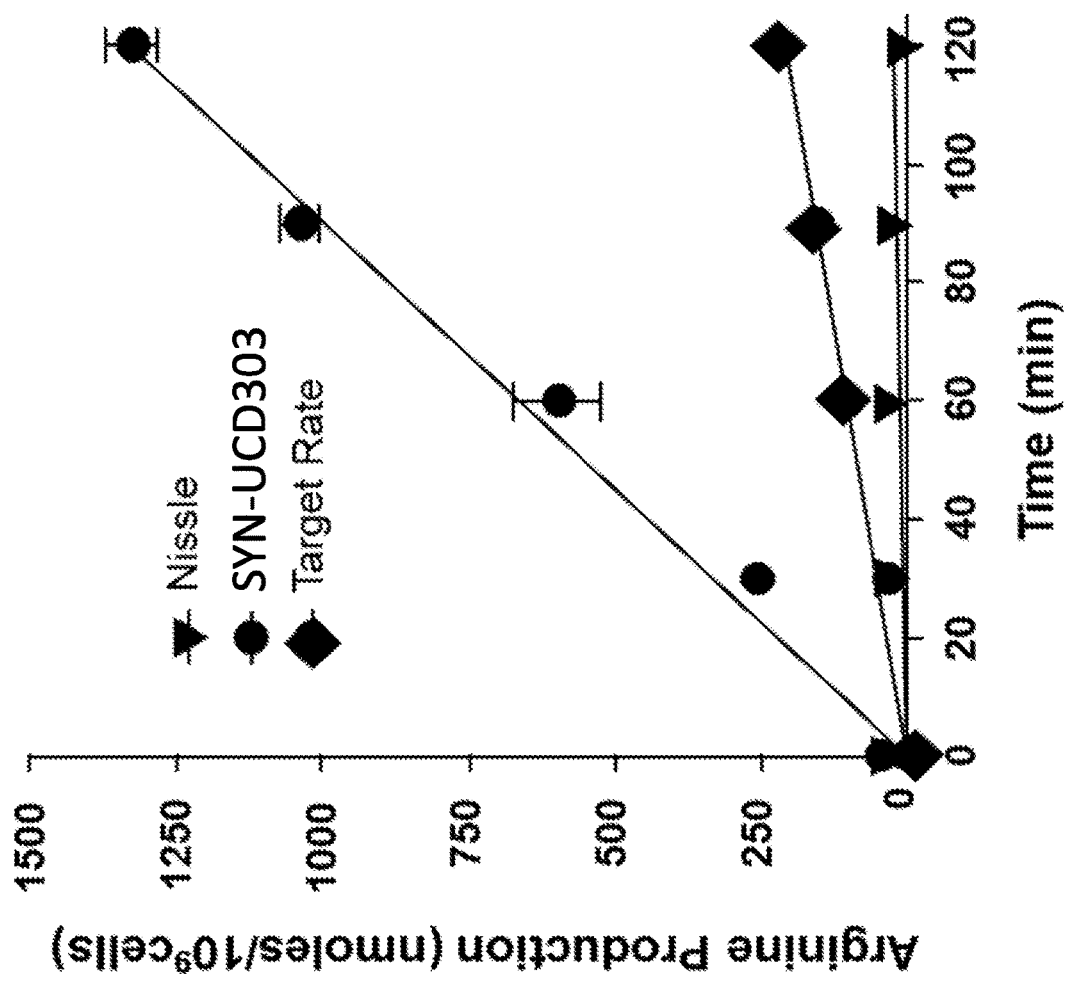

FIG. 26 depicts a line graph showing the in vitro efficacy (arginine production from ammonia) in an engineered bacterial strain harboring a chromosomal insertion of ArgAfbr driven by an fnr inducible promoter at the malEK locus, with ΔArgR and ΔThyA and no antibiotic resistance was assessed (SYN-UCD303). Streptomycin resistant E coli Nissle (Nissle) is used as a reference.

Figure 27A:
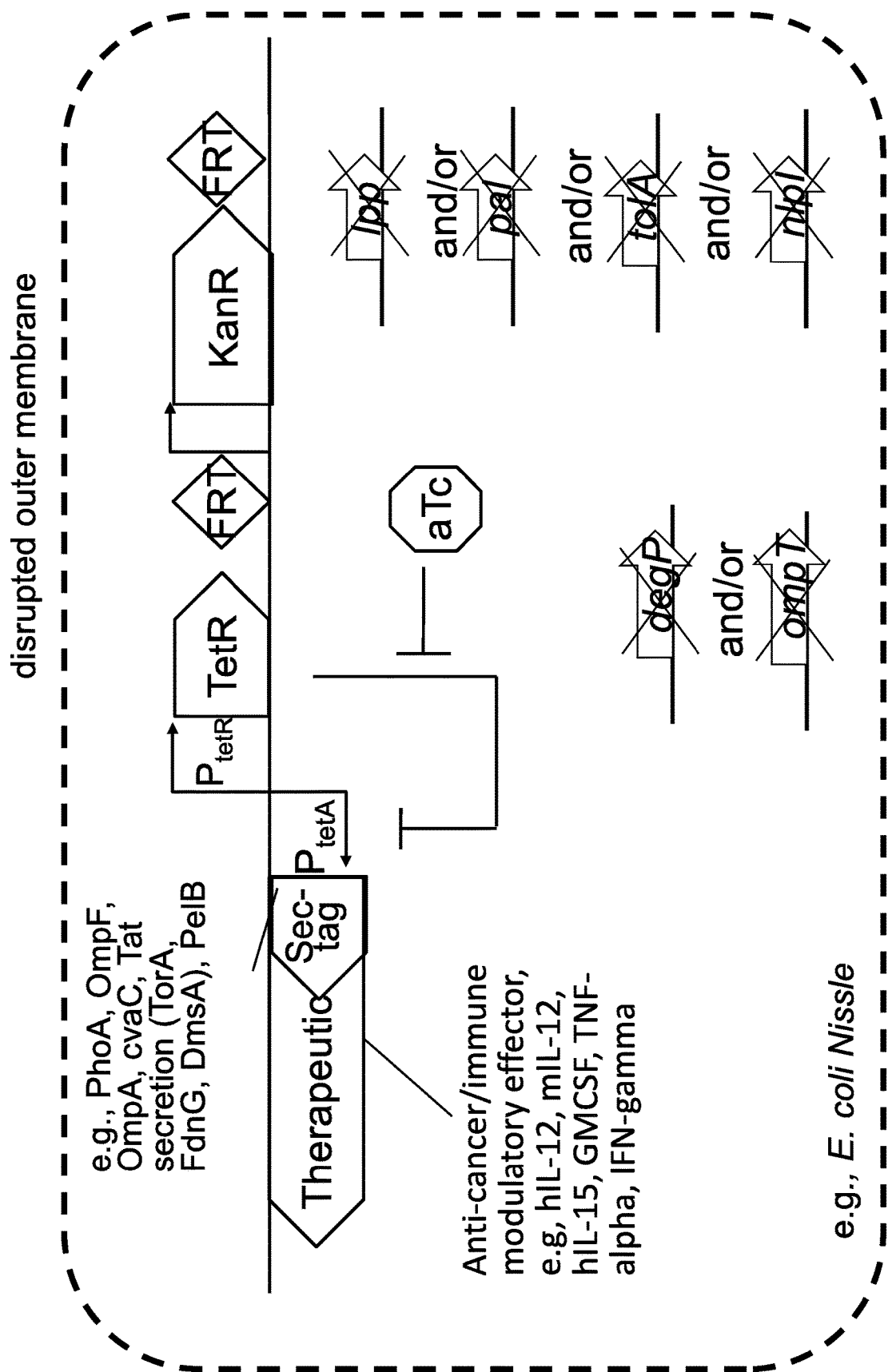
Figure 27B:
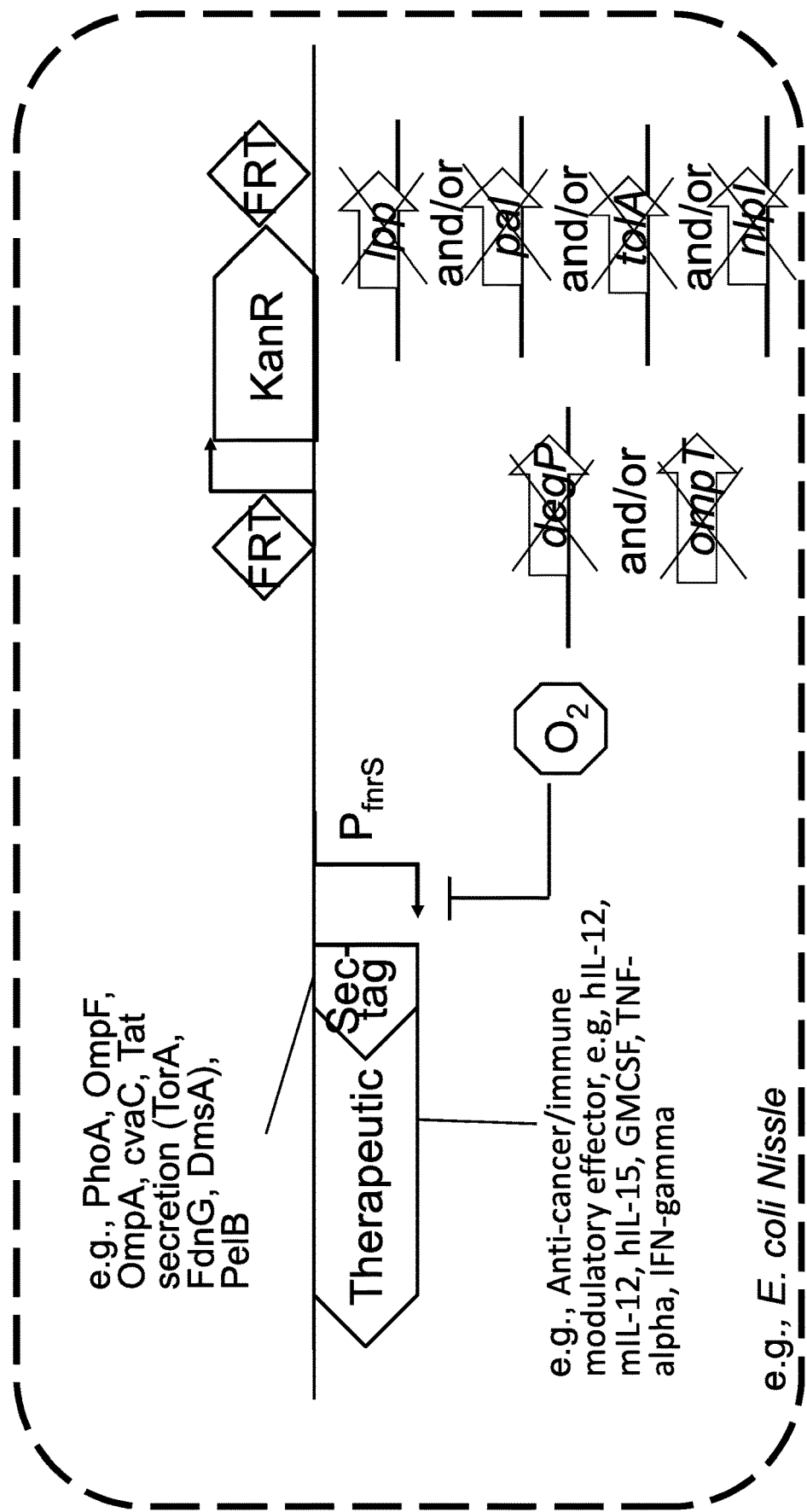

FIG. 27A and FIG. 27B depict schematics of the gene organization of exemplary circuits of the disclosure for the expression of therapeutic polypeptides, e.g., anti-cancer/immune modulatory effectors described herein, e.g, hIL-12, mIL-12, hIL-15, GMCSF, TNF-alpha, and/or IFN-gamma, which are secreted via a diffusible outer membrane (DOM) system. The therapeutic polypeptide of interest is fused to a prototypical N-terminal Sec-dependent secretion signal or Tat-dependent secretion signal, which is cleaved upon secretion into the periplasmic space. Exemplary secretion tags include sec-dependent PhoA, OmpF, OmpA, cvaC, and Tat-dependent tags (TorA, FdnG, DmsA). In certain embodiments, the genetically engineered bacteria comprise deletions in one or more of lpp, pal, tolA, and/or nlpI. Optionally, periplasmic proteases are also deleted, including, but not limited to, degP and ompT, e.g., to increase stability of the polypeptide in the periplasm. A FRT-KanR-FRT cassette is used for downstream integration. Expression is driven by a tet promoter (FIG. 27A) or an inducible promoter, such as oxygen level-dependent promoters (e.g., FNR-inducible promoter, FIG. 27B), and promoters induced by a metabolite that may or may not be naturally present (e.g., can be exogenously added) in the gut, e.g., arabinose. In certain embodiments the one or more cassettes are under the control of constitutive promoters.

Figure 28A:
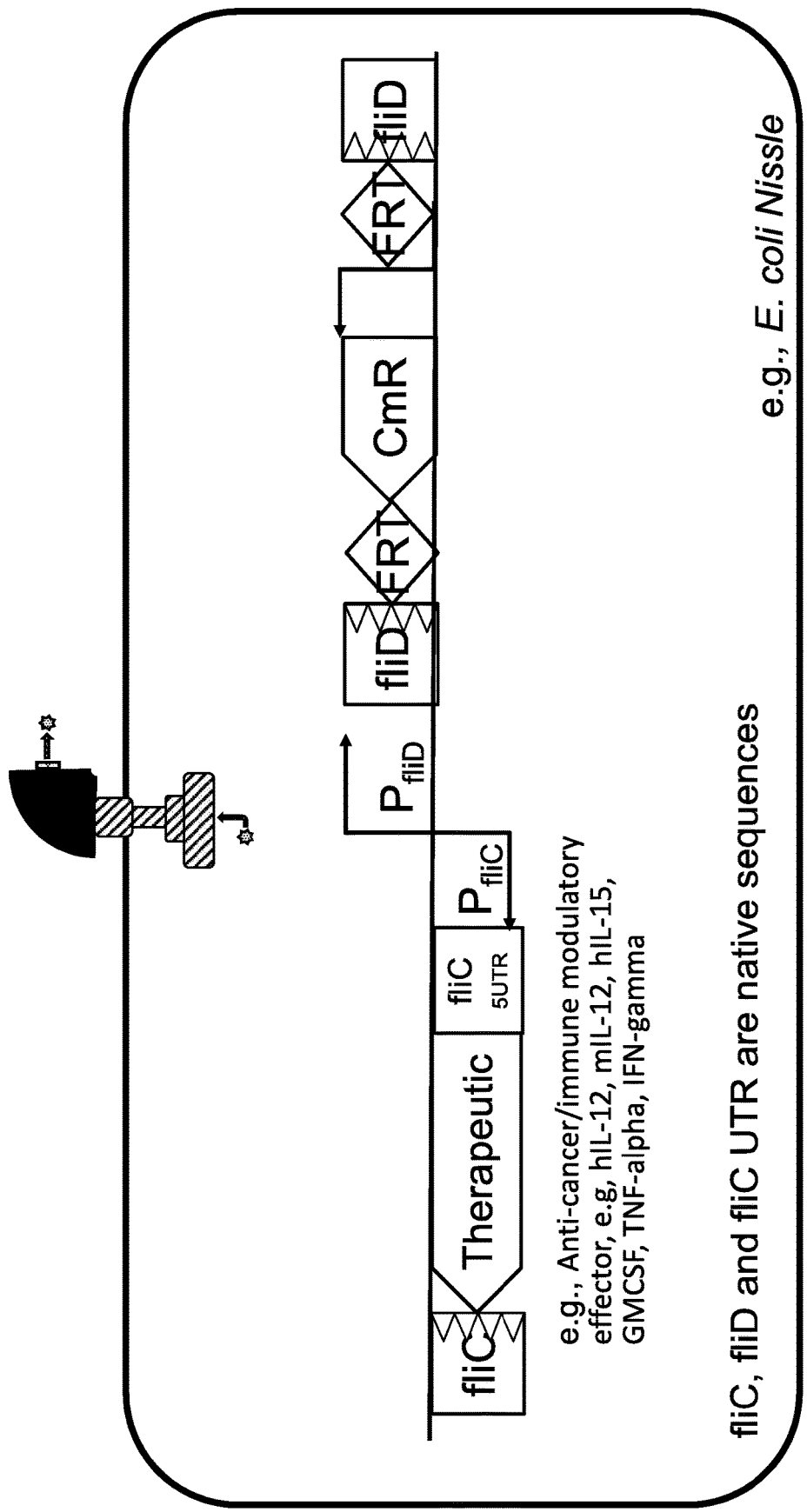
Figure 28B:
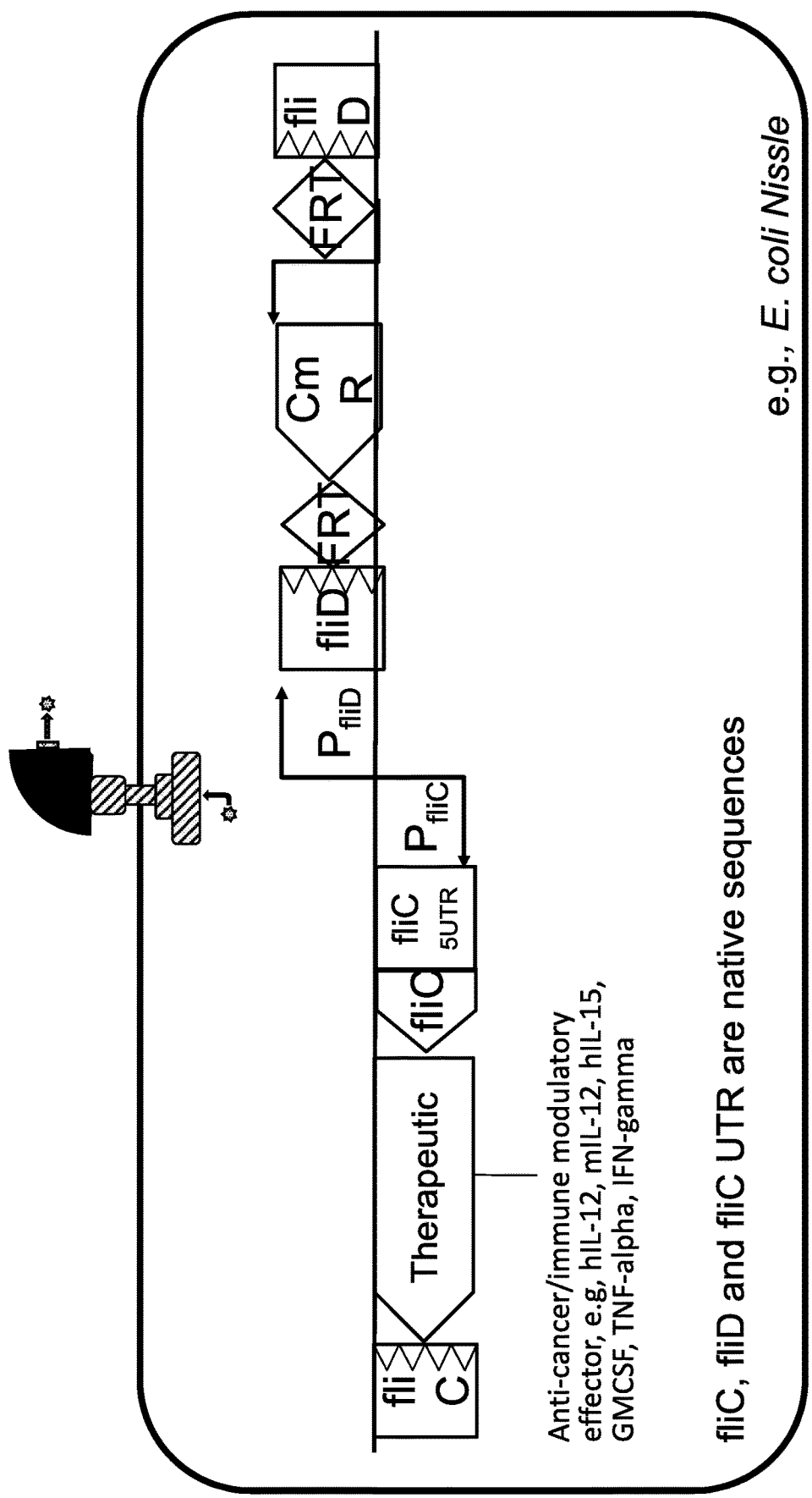
Figure 28C:
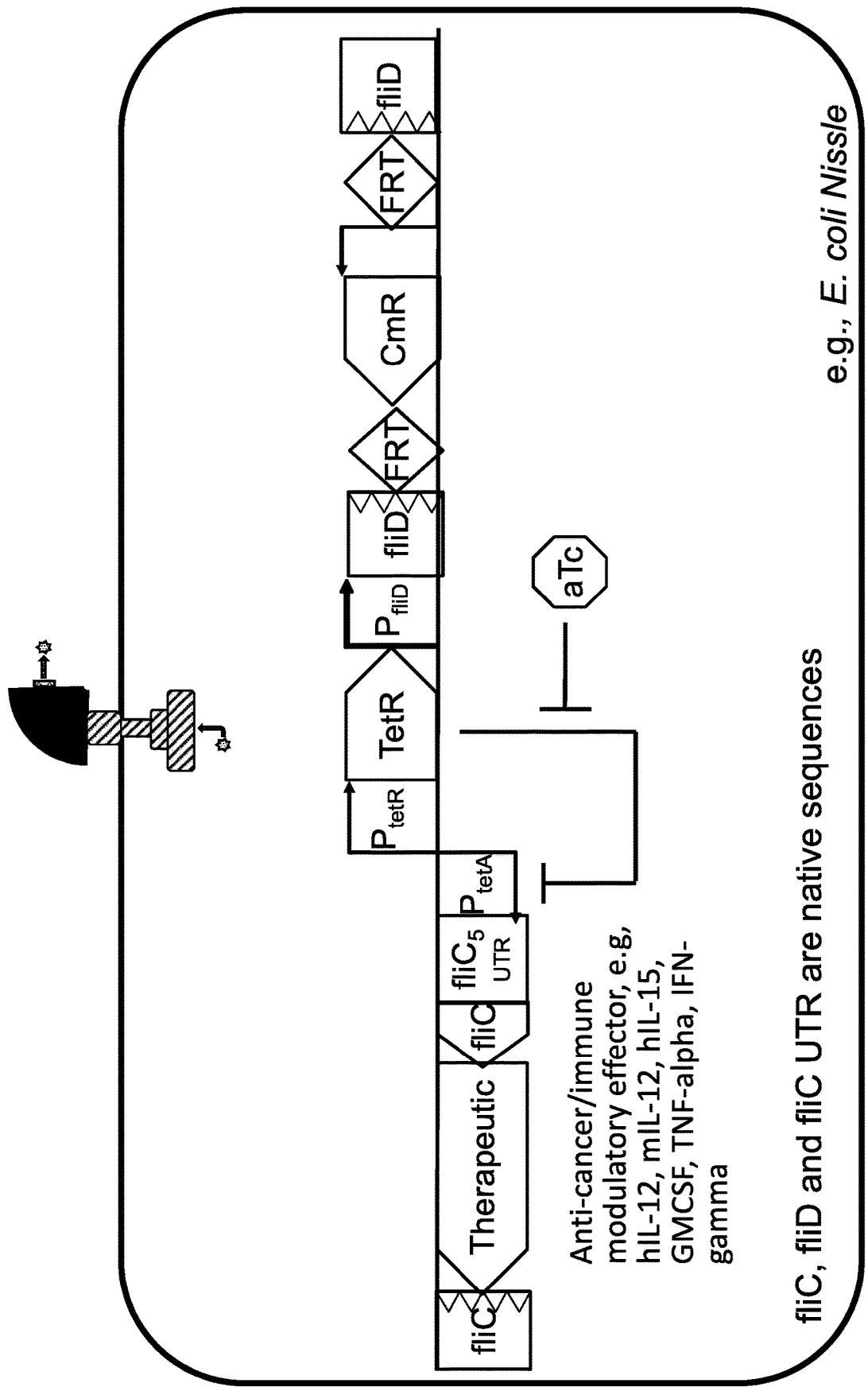

FIG. 28A, FIG. 28B, and FIG. 28C depict schematics of the gene organization of exemplary circuits of the disclosure for the expression of therapeutic polypeptides, e.g., anti-cancer/immune modulatory effectors described herein, e.g, hIL-12, mIL-12, hIL-15, GMCSF, TNF-alpha, and/or IFN-gamma, which are secreted using components of the flagellar type III secretion system. A therapeutic polypeptide of interest, is assembled behind a fliC-5'UTR, and is driven by the native fliC and/or fliD promoter (FIG. 28A and FIG. 28B) or a tet-inducible promoter (FIG. 28C). In alternate embodiments, an inducible promoter such as oxygen level-dependent promoters (e.g., FNR-inducible promoter), and promoters induced by a metabolite that may or may not be naturally present (e.g., can be exogenously added) in the gut, e.g., arabinose can be used. In certain embodiments the one or more cassettes are under the control of constitutive promoters. The therapeutic polypeptide of interest is either expressed from a plasmid (e.g., a medium copy plasmid) or integrated into fliC loci (thereby deleting all or a portion of fliC and/or fliD). Optionally, an N terminal part of FliC is included in the construct, as shown in FIG. 28B and FIG. 28C.

Figure 29:
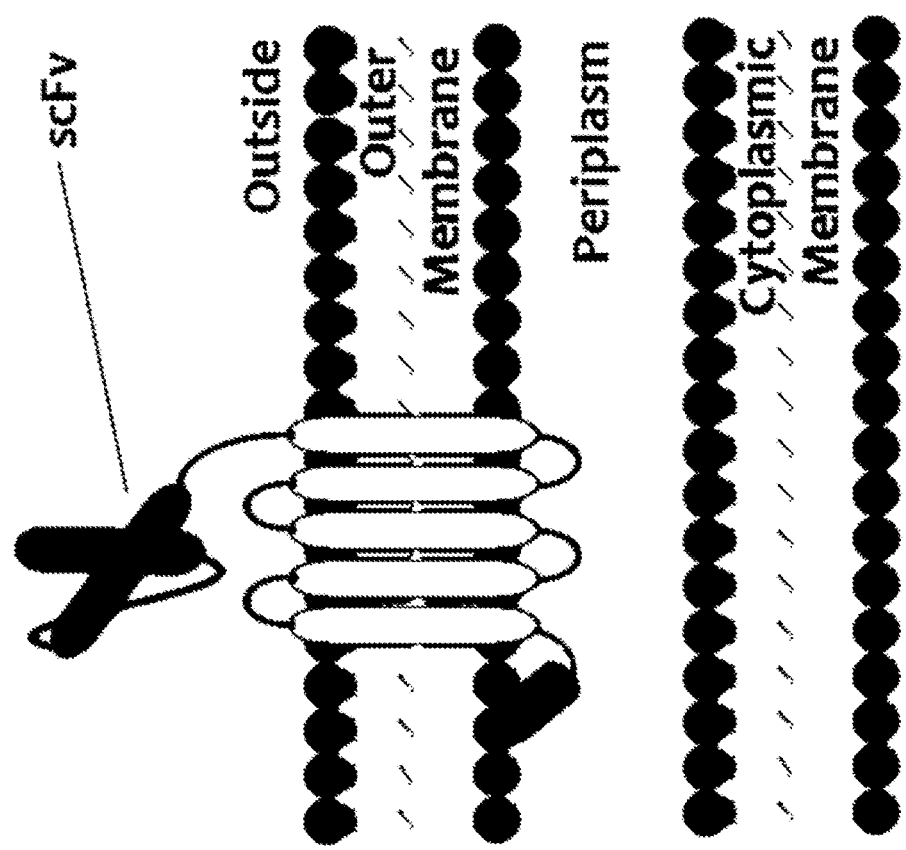

FIG. 29 depicts a schematic of a polypeptide of interest displayed on the surface of the bacterium. A non-limiting example of such a therapeutic protein is a scFv. The polypeptide is expressed as a fusion protein, which comprises a outer membrane anchor from another protein, which was developed as part of a display system. Non-limiting examples of such anchors are described herein and include LppOmpA, NGIgAsig-NGIgAP, InaQ, Intimin, Invasin, pelB-PAL, and blcA/BAN. In a nonlimiting example a bacterial strain which has one or more diffusible outer membrane phenotype ("leaky membrane") mutation, e.g., as described herein.

Figure 30:
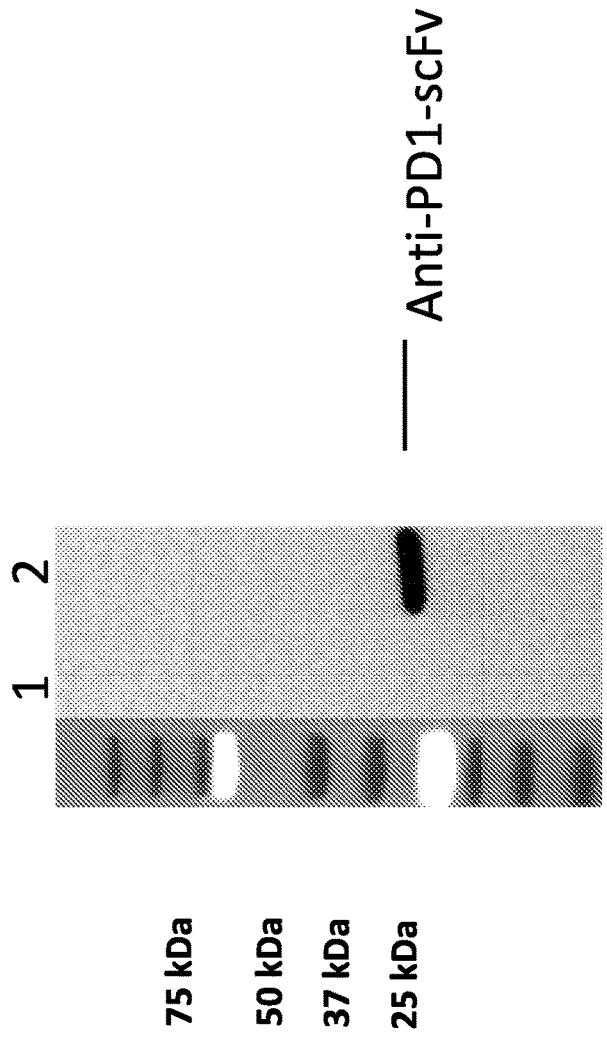

FIG. 30 depicts a Western Blot analysis of total cytosolic extracts of a wild type *E. coli* (lane 1) and of a strain expressing anti-PD1 scFv (lane 2).

Figure 31:
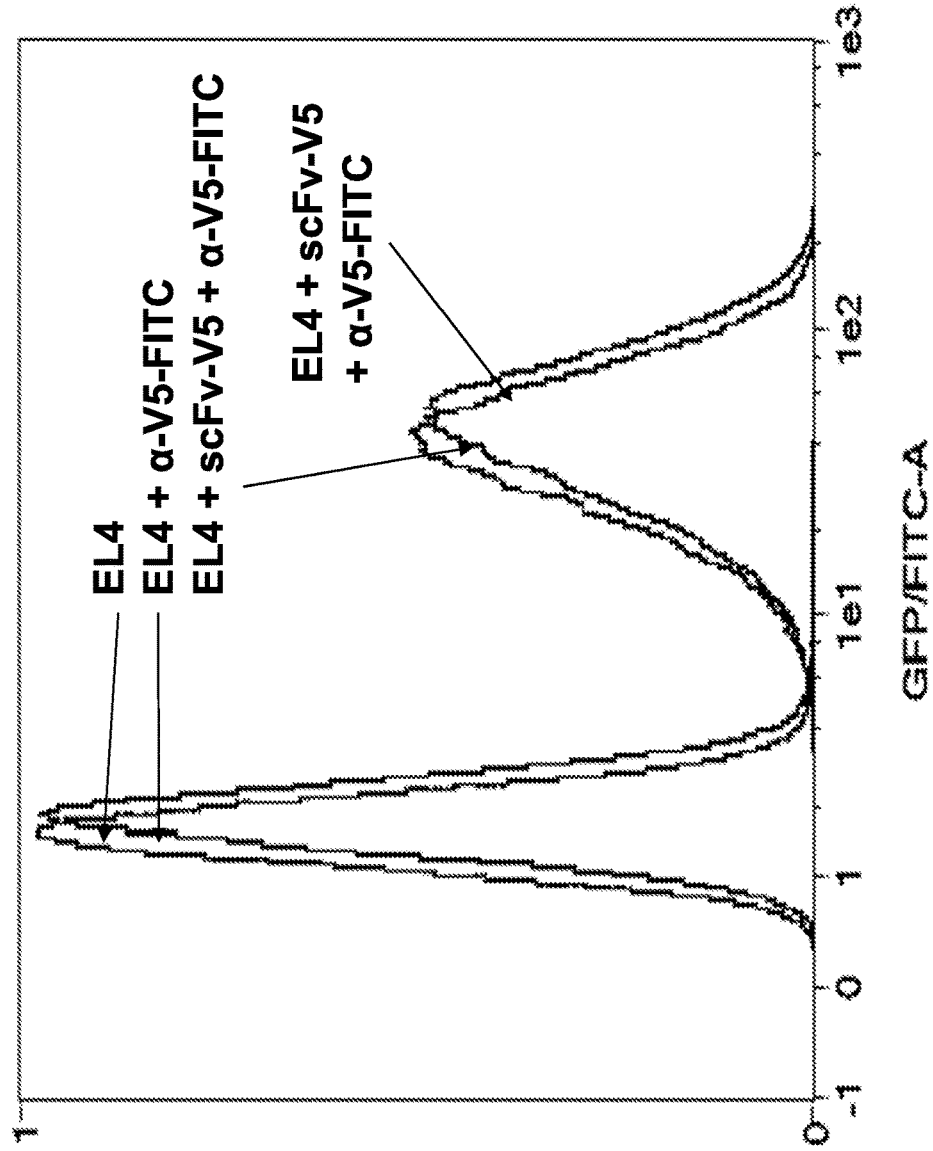

FIG. 31 depicts a diagram of a flow cytometric analysis of PD1 expressing EL4 cells which were incubated with extracts from a strain expressing tet inducible anti-PD1-scFv, and showing that anti-PD1-scFv expressed in *E. coli* binds to PD1 on mouse EL4 cells.

Figure 32:
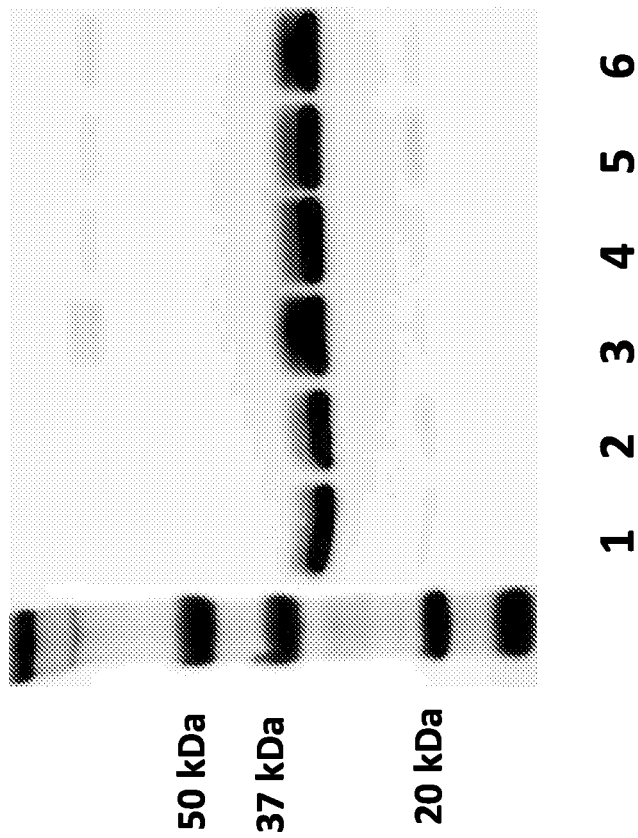

FIG. 32 depicts a Western Blot analysis of total cytosolic extracts of various strain secreting anti-PD1 scFv. A single band was detected around 34 kDa in lane 1-6 corresponding to extracts from SYN2767, SYN2769, SYN2771, SYN2773, SYN2775 and SYN2777 respectively.

Figure 33:
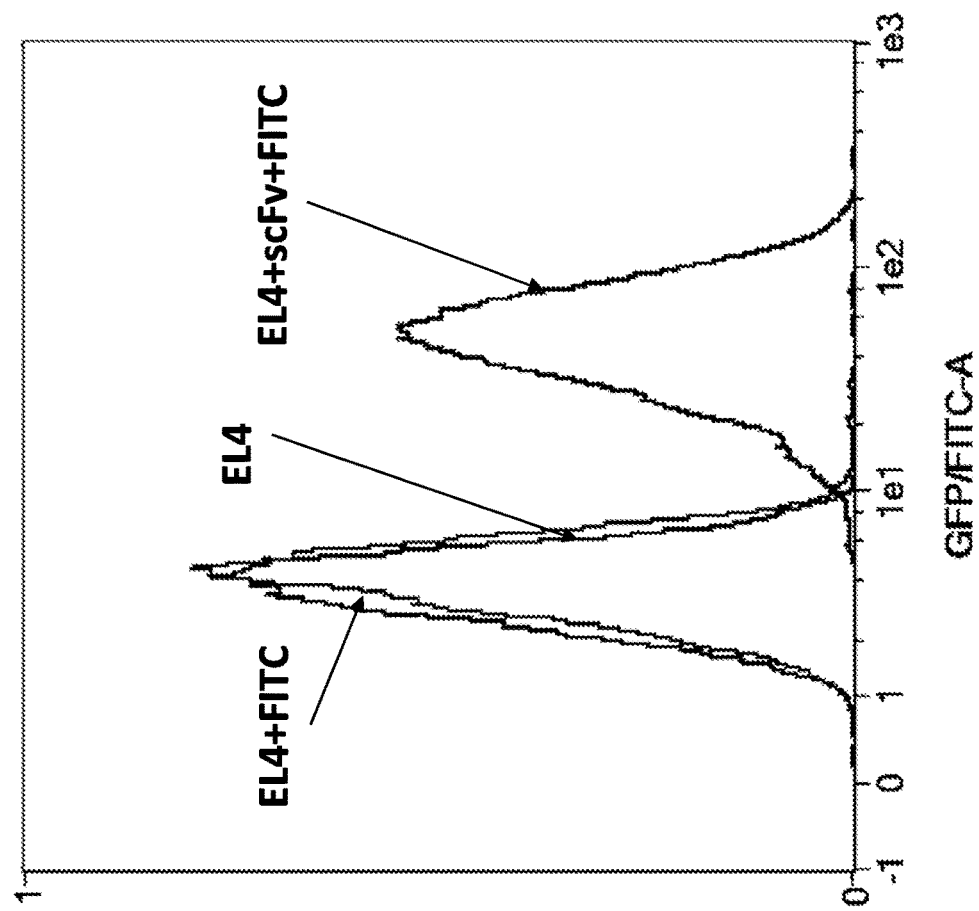

FIG. 33 depicts a diagram of a flow cytometric analysis of PD1 expressing EL4 cells, which were incubated with extracts from a *E coli* Nissle strain secreting tet-inducible anti-PD1-scFv, showing that anti-PD1-scFv secreted from *E. coli* Nissle binds to PD1 on mouse EL4 cells.

Figure 34:
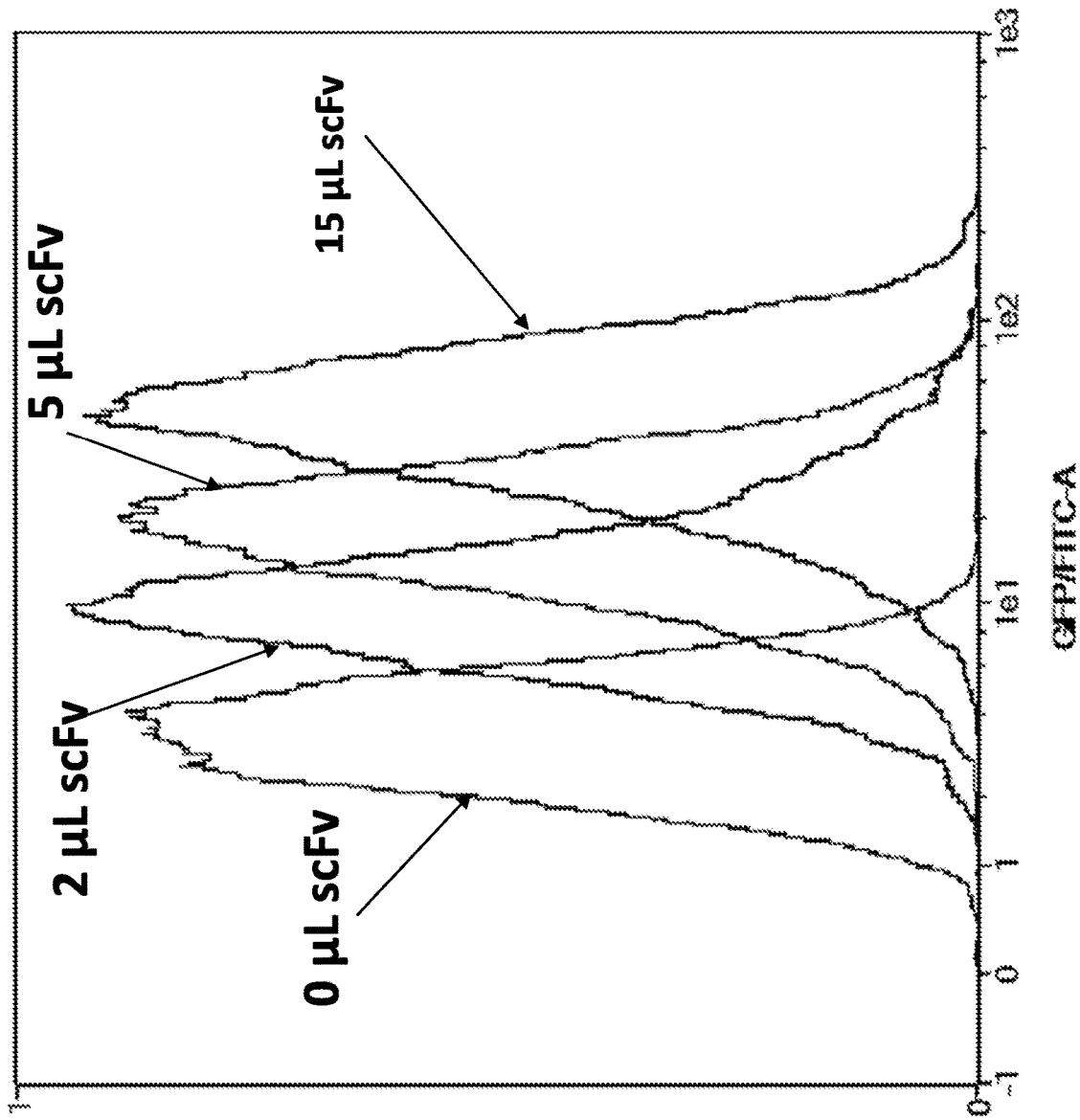

FIG. 34 depicts a diagram of a flow cytometric analysis of PD1 expressing EL4 cells, which were incubated with various amounts of extracts (0, 2, 5, and 15 ul) from an *E. coli* Nissle strain secreting tet-inducible anti-PD1-scFv, showing that anti-PD1-scFv secreted from *E. coli* Nissle binds to PD1 on mouse EL4 cells, in a dose dependent manner.

FIG. 35 depicts a diagram of a flow cytometric analysis of EL4 cells. A competition assay was conducted, in which extracts from a *E coli* Nissle strain secreting tet-inducible anti-PD1-scFv was incubated with various amounts of soluble PDL1 (0, 5, 10, and 30 ug) showing that PDL1 can dose-dependently compete with the binding of anti-PD1-scFv secreted from *E. coli* Nissle to PD1 on mouse EL4 cells.

Figure 36A:
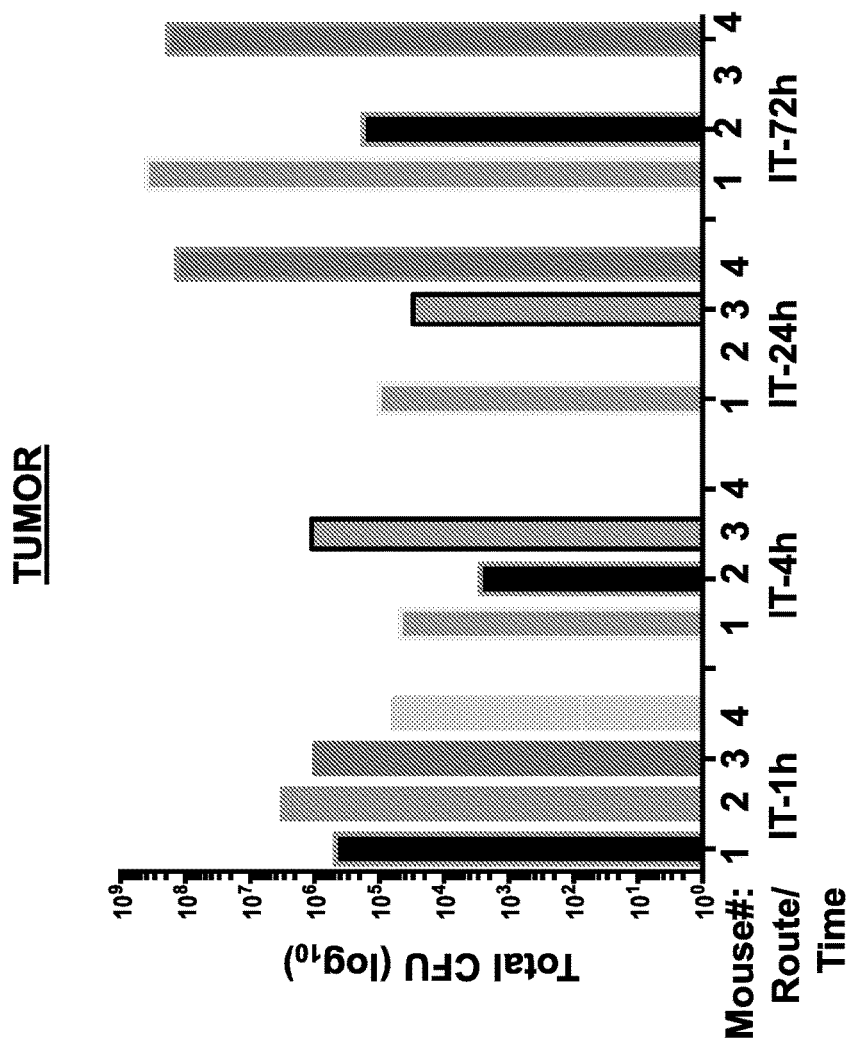
Figure 36B:
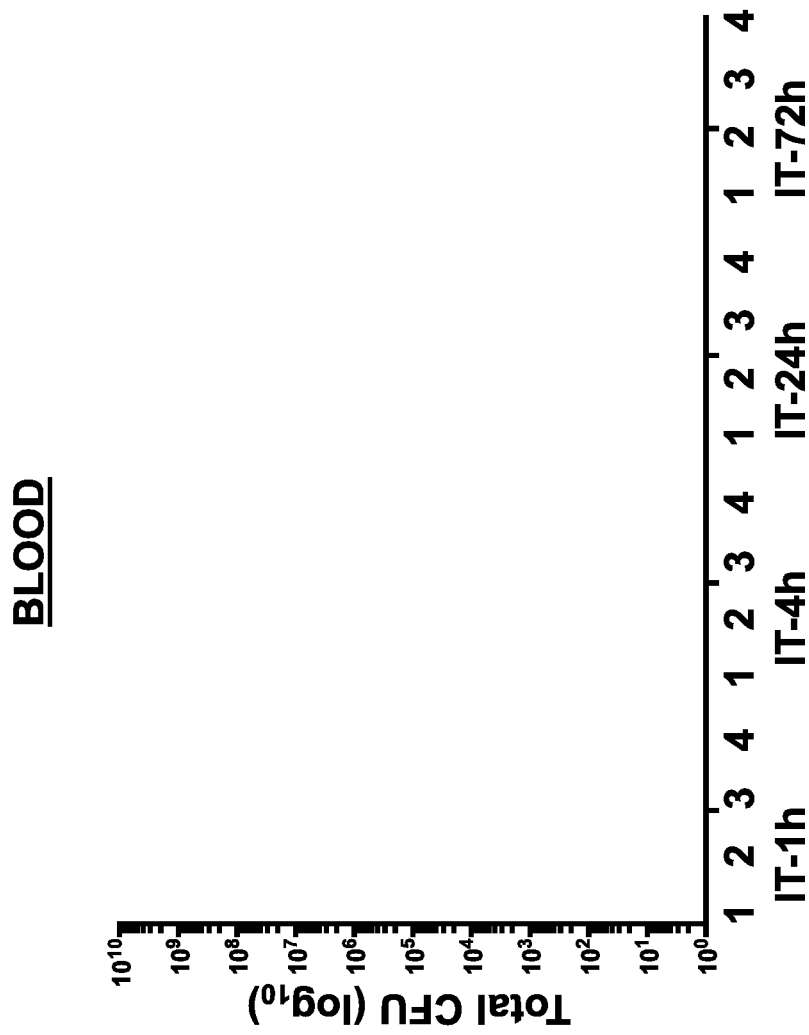

FIG. 36A and FIG. 36B depict bar graphs of bacterial residence time of SYN94 (Nissle) in the tumor (FIG. 36A) and the blood (FIG. 36B) in the CT26 syngeneic tumor model at 1, 4, 24, and 72 hours after Nissle was administered to mice.

Figure 37A:
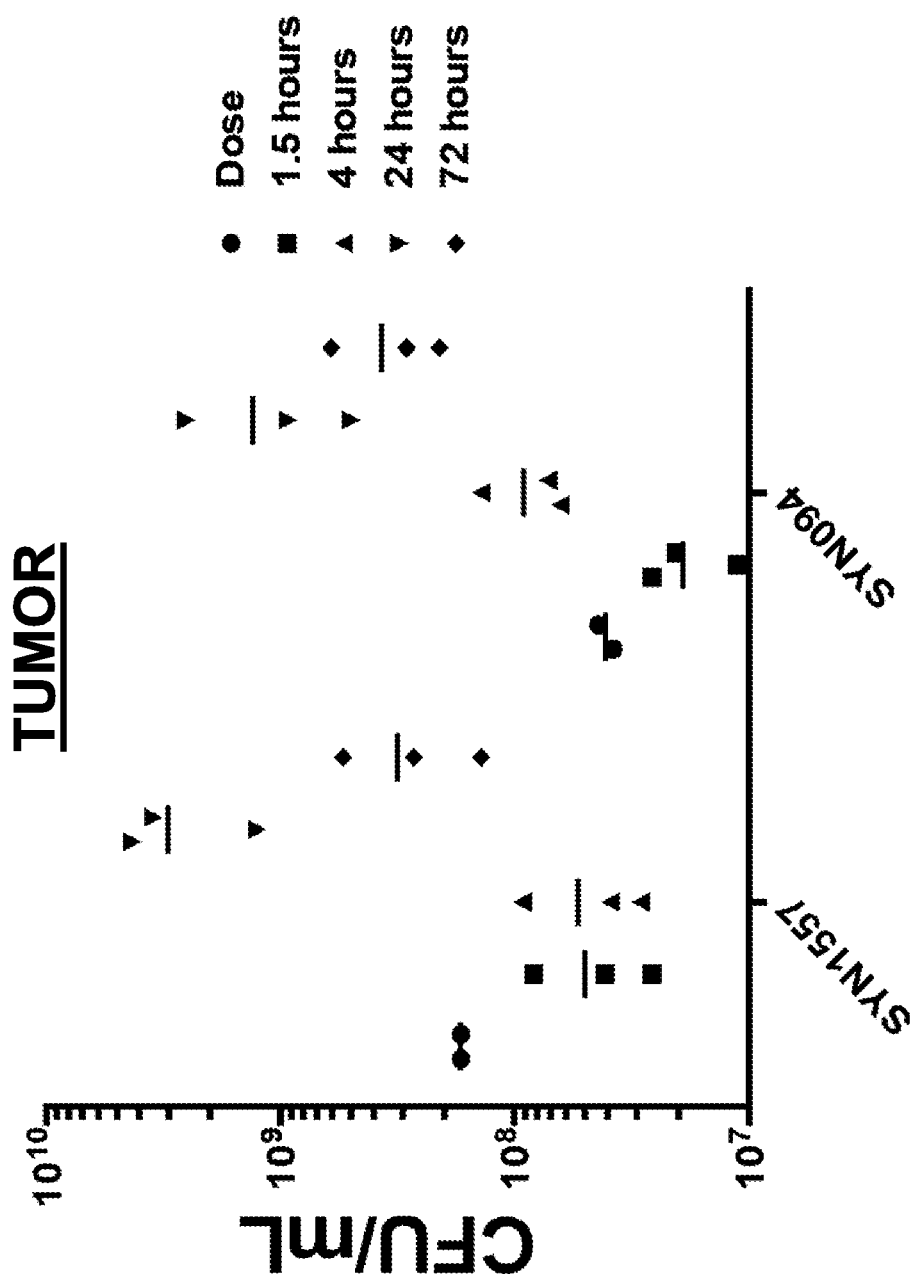
Figure 37B:
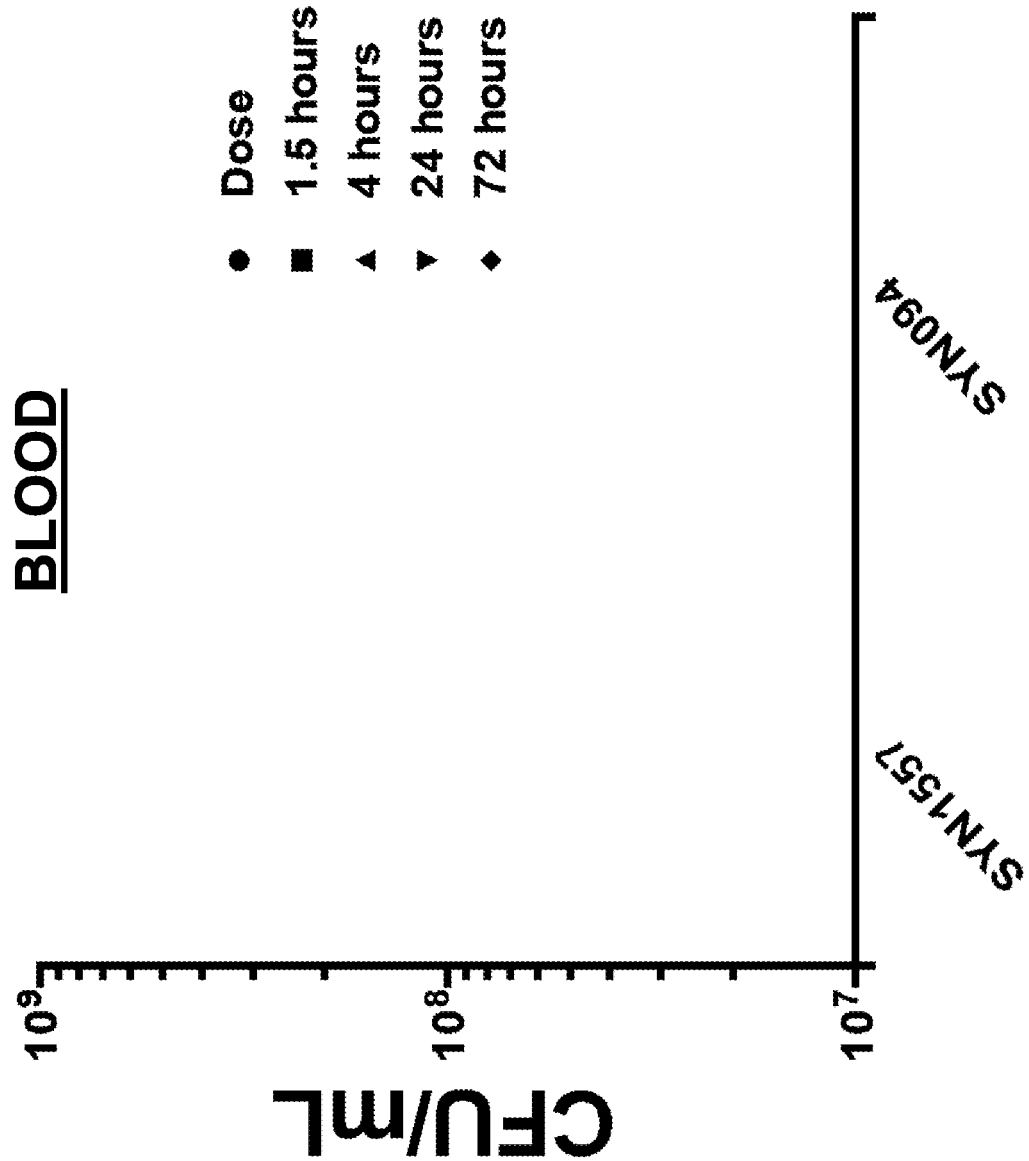

FIG. 37A and FIG. 37B depicts graphs showing CFU of bacteria detected in the tumor (FIG. 37A) and in blood (FIG. 37B) at various time points post intratumoral (IT) dose with 100 ul SYN94 (streptomycin resistant Nissle) or SYN1557 (Nissle delta PAL::CmR) (1e7 cells/dose).

Figure 38:
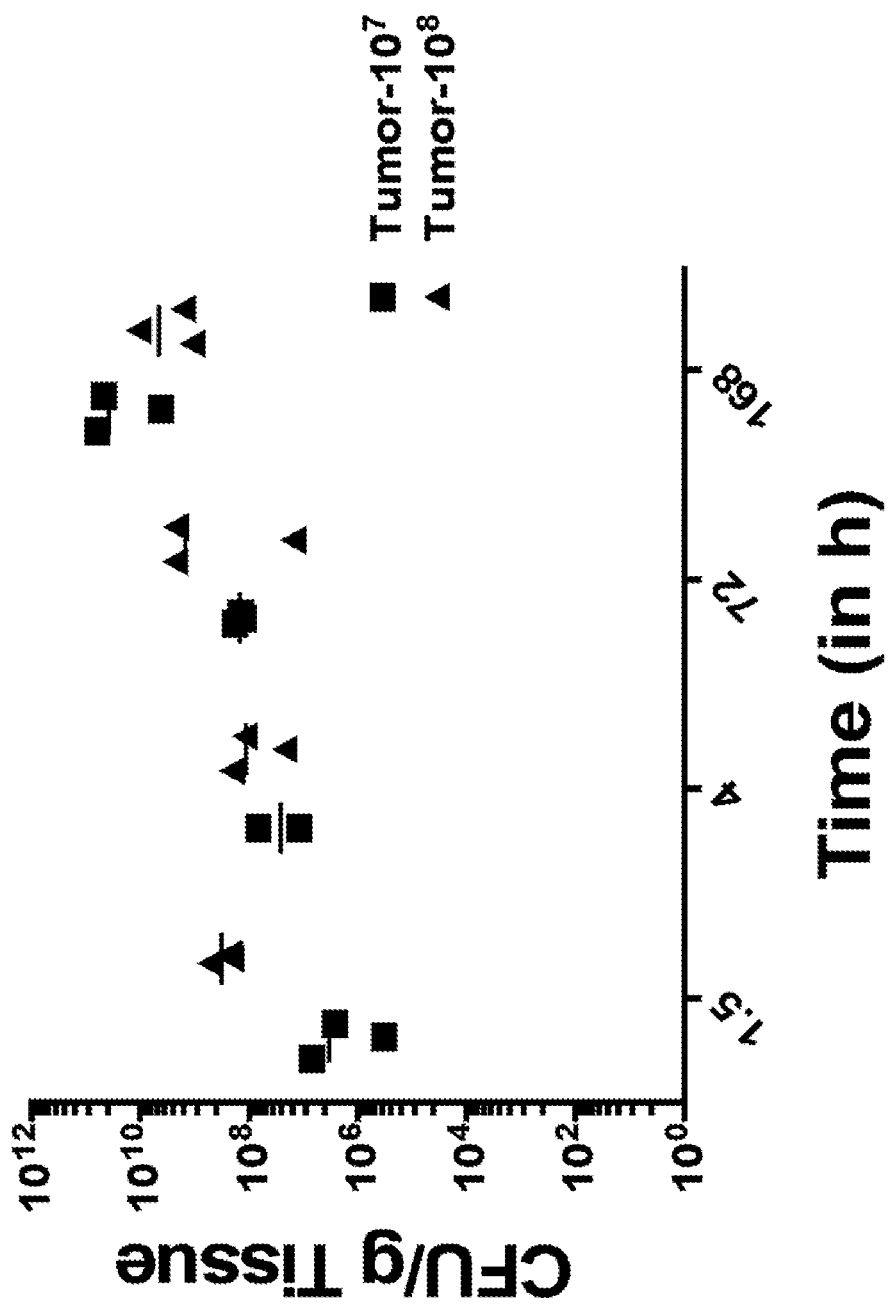

FIG. 38 depicts a graph showing CFU of bacteria detected in the tumor (at various time points post intratumoral (IT) dose with 100 ul SYN94 (streptomycin resistant Nissle) at 1e7 and 1e8 cells/dose. Bacterial counts in the tumor tissue were similar at both doses.

Figure 39A:
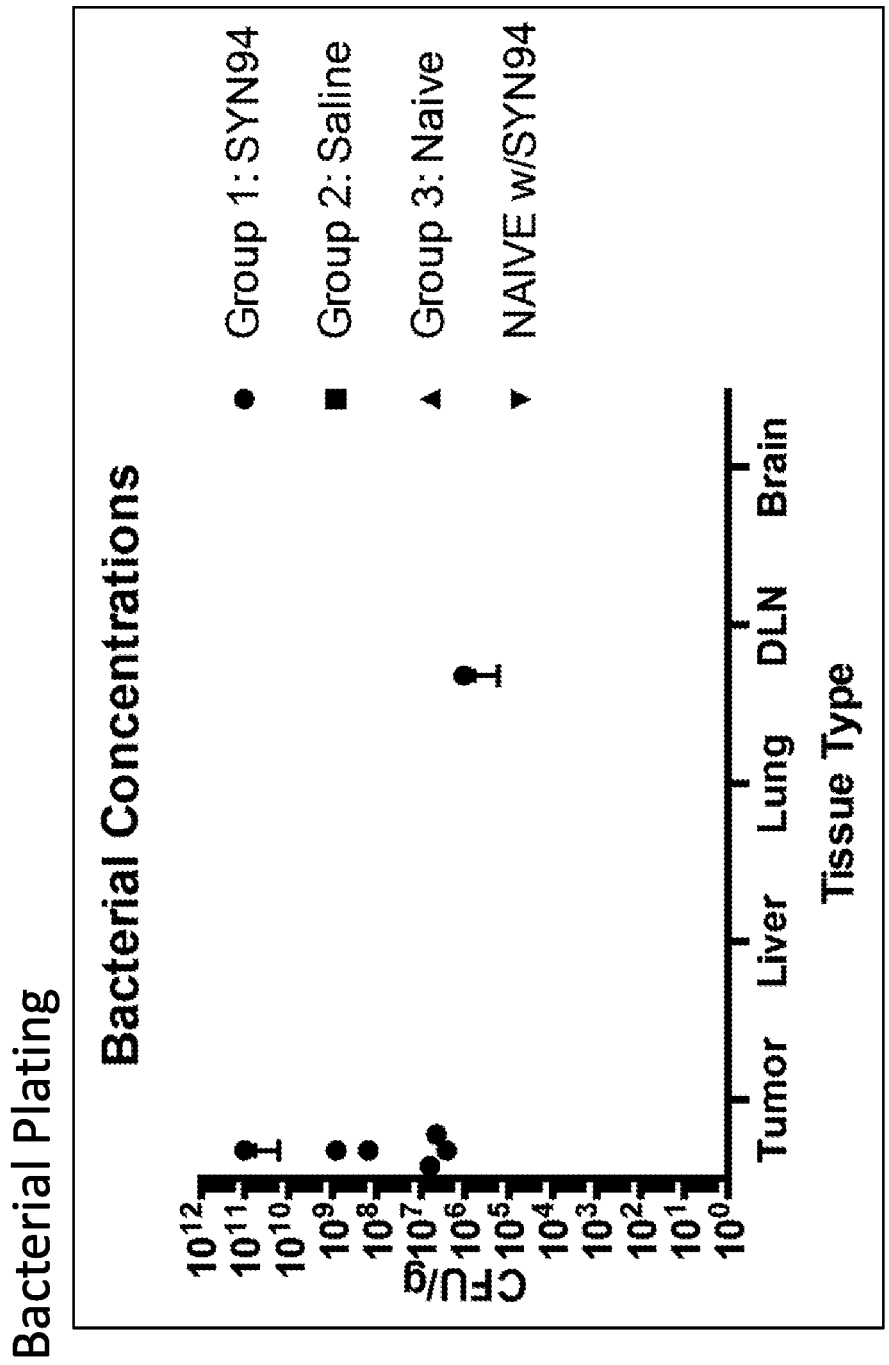
Figure 39B:
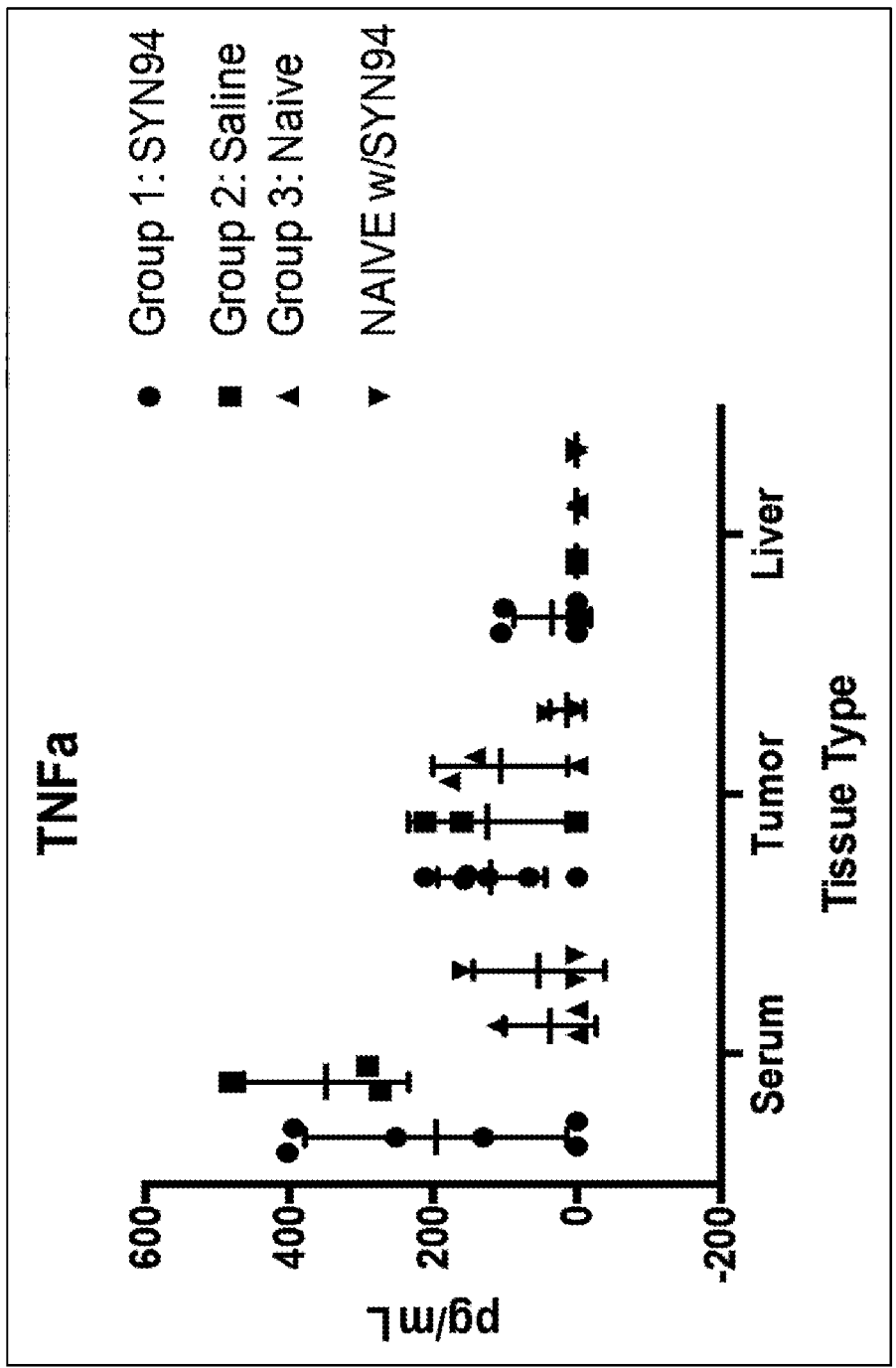

FIG. 39A and FIG. 39B depict graphs showing bacterial concentrations detected in various tissues (FIG. 39A) and TNFa levels measured in serum, tumor and liver (FIG. 39B) at 48 hours post intratumor administration $10^7$ CFU/dose SYN94 (streptomycin resistant Nissle) or saline administration and in naïve animals. Bacteria were predominantly present in the tumor and absent in other tissues tested. TNFa levels measured were similar in all serum, tumor and liver between SYN94, Saline treated and naïve groups.

Figure 40:
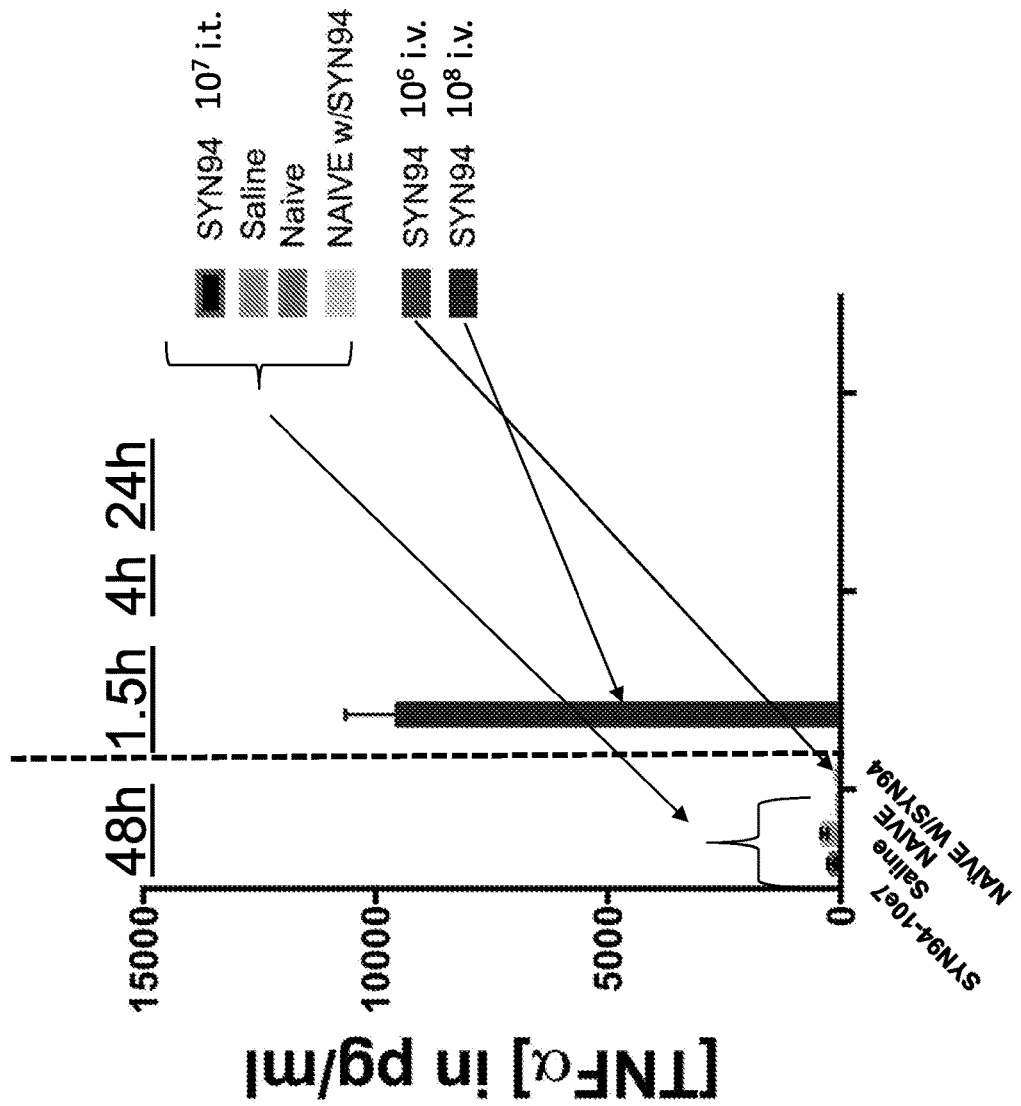

FIG. 40 depicts a bar graph showing TNF alpha levels at 48 hours post intratumor injection and at various time points post IV injection. TNFalpha levels are negligible relative to TNFalpha levels measured at 1.5 hours when Nissle is administered at 1e8 via IV (resulting in lethality) Similar low levels of TNFa are detected at a 1e6 IV dose of SYN94.

Figure 41A:
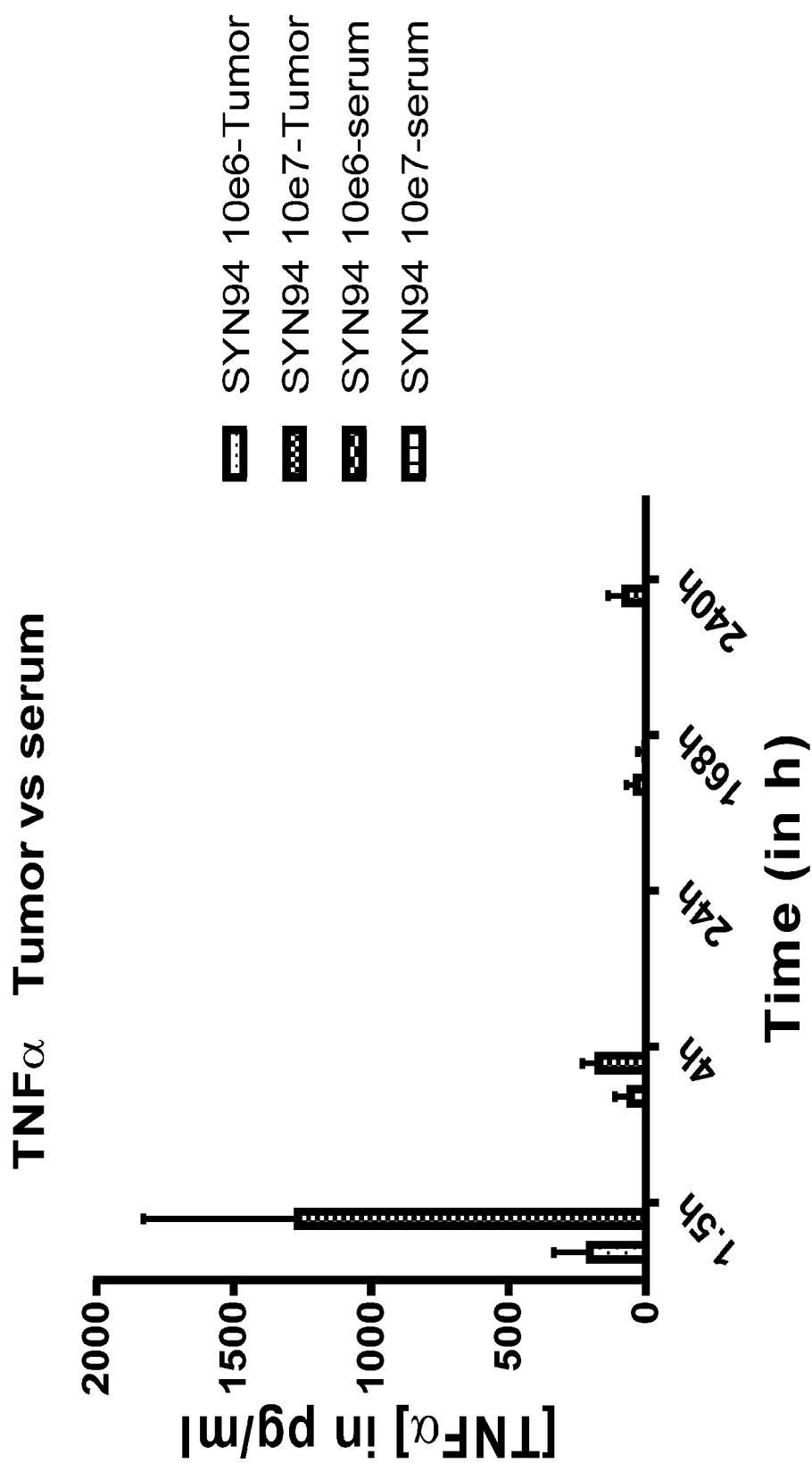
Figure 41B:
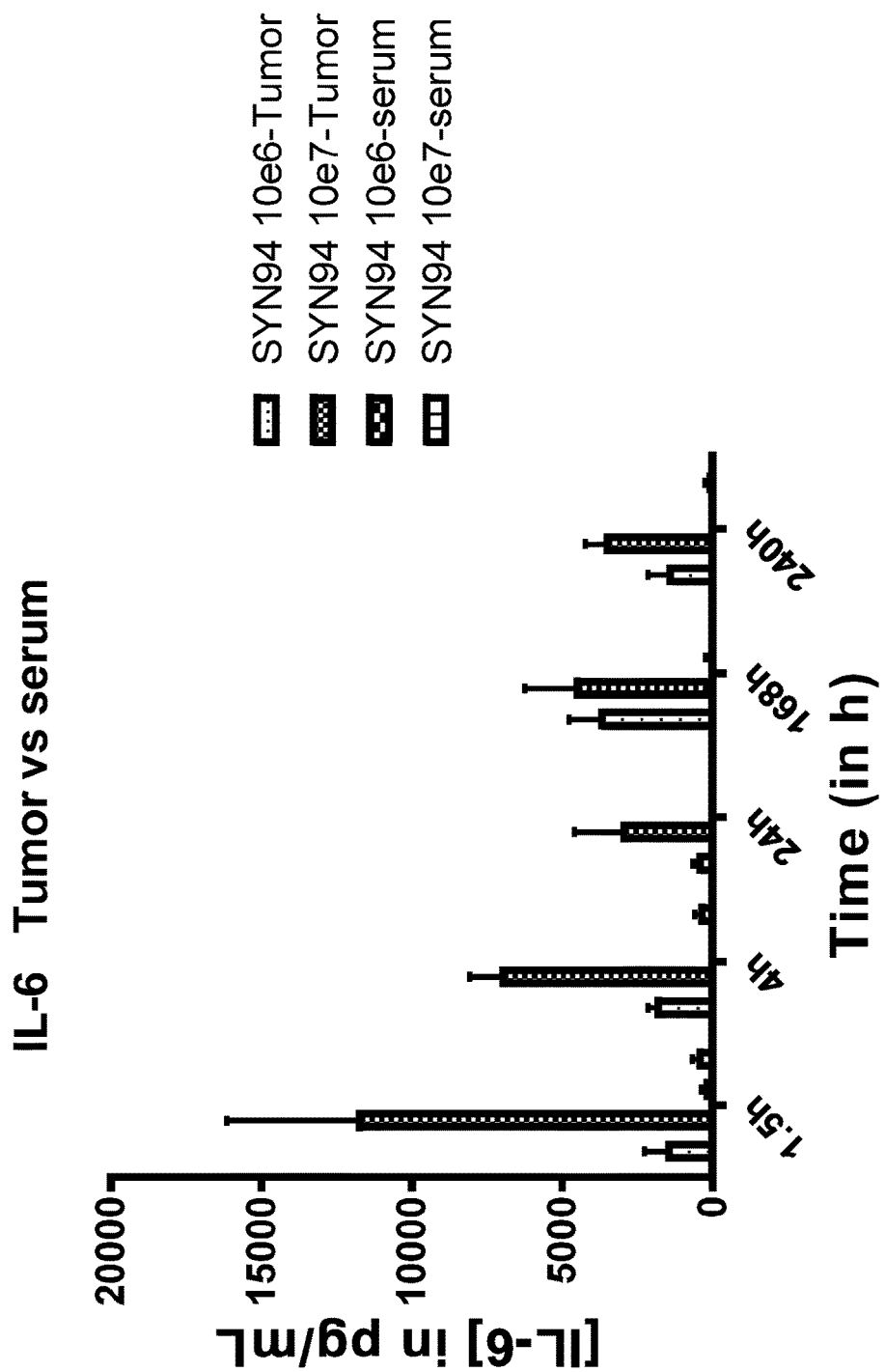
Figure 41C:
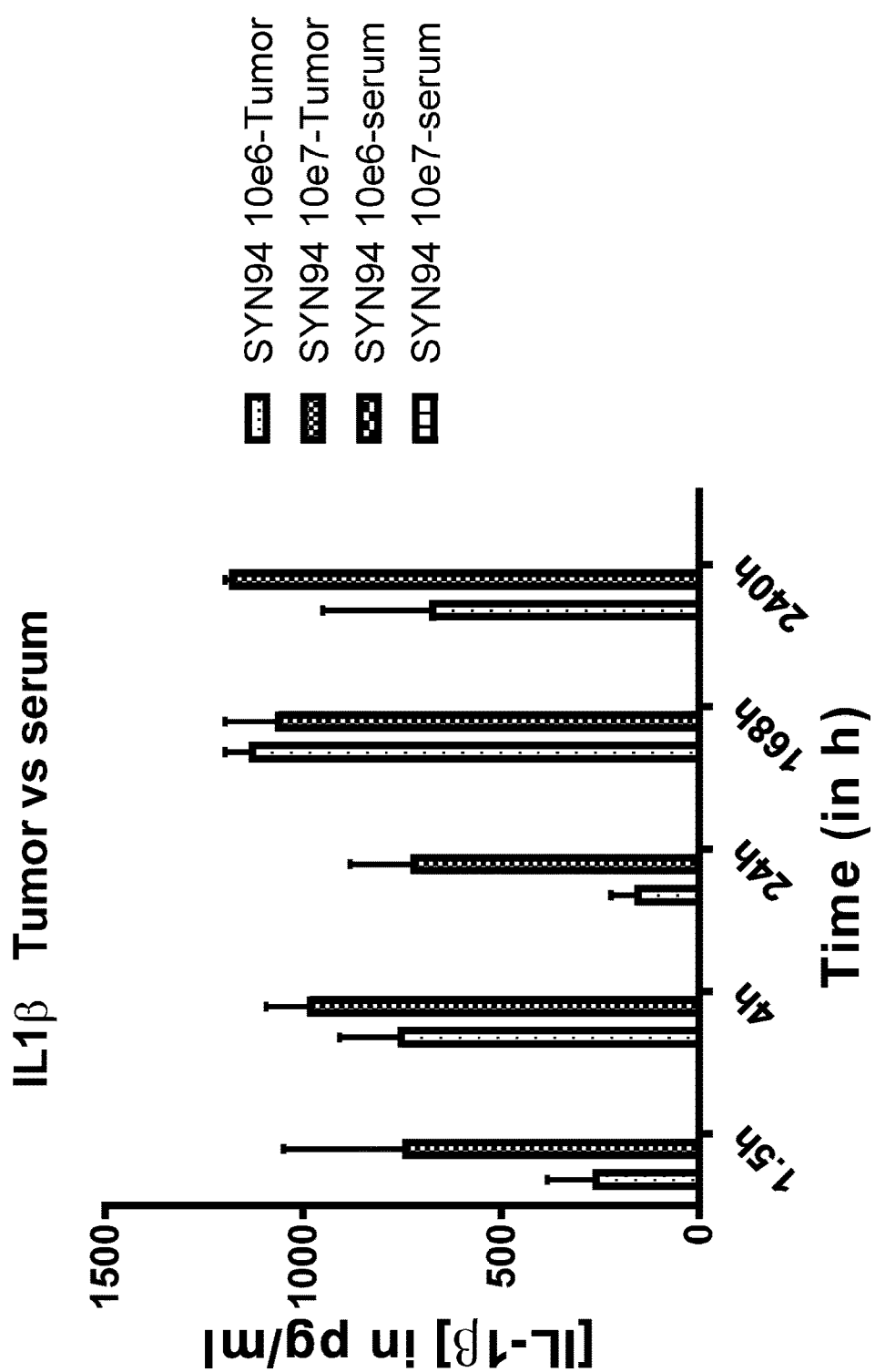

FIG. 41A, FIG. 41B, and FIG. 41C depict bar graphs of TNFalpha (FIG. 41A), IL-6 (FIG. 41B), and IL-1beta (FIG. 41C) levels measured in serum and in the tumor over the time course post SYN94 intratumoral administration at the indicated doses. Results indicate that a cytokine response is elicited in the tumor at the higher dose but not in the serum. The lower dose does not elicit a substantial cytokine response.

Figure 42:
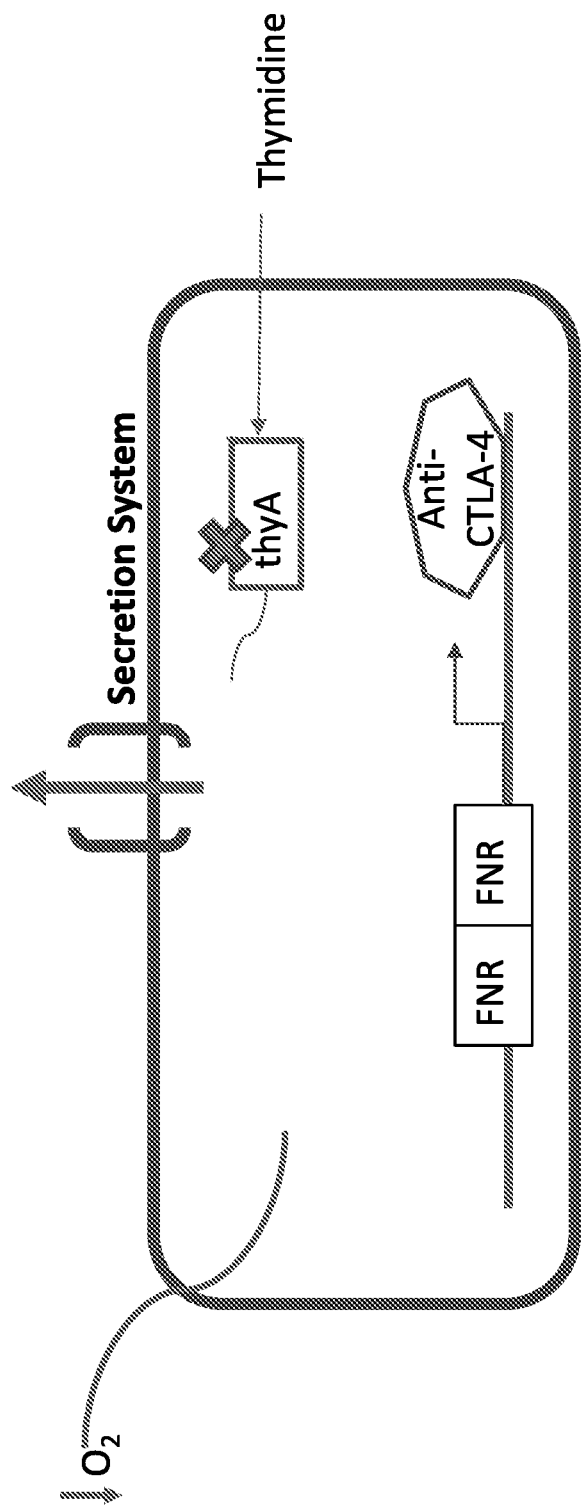

FIG. 42 shows a schematic depicting a microorganism having a secretion system used to secrete a therapeutic peptide or protein (e.g., anti-CTLA-4). An inducible promoter, e.g., a FNR-inducible promoter, is used to drive the expression of the therapeutic peptide. The bacteria may also include an auxotrophy, e.g., deletion of thyA (Δ thyA; thymidine dependence). Non-limiting examples of bacterial strains are listed.

Figure 43:
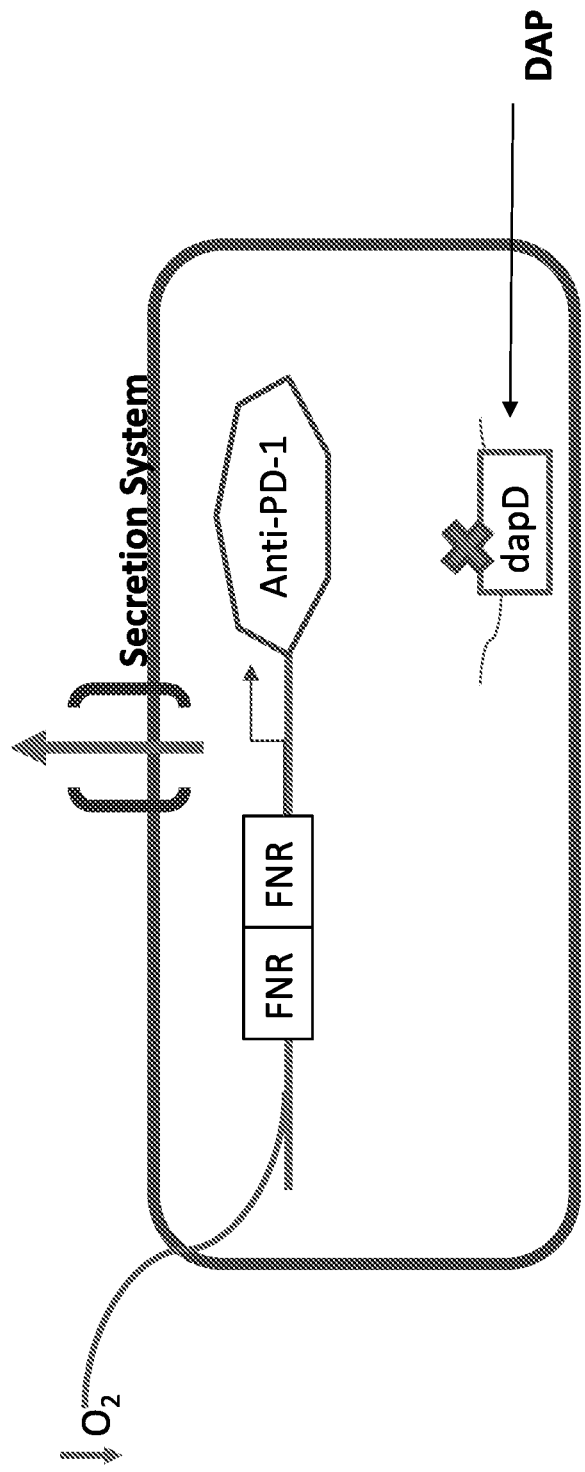

FIG. 43 shows a schematic depicting a microorganism having a non-native secretion system used to secrete a therapeutic peptide (e.g., anti-PD-1). An inducible promoter, e.g., FNR is used to drive the expression of the therapeutic peptide. The bacteria may also include an auxotrophy, e.g., deletion of dapD (Δ dapD; DAP or diaminopimelic acid dependence). Non-limiting examples of bacterial strains are listed.

Figure 44:
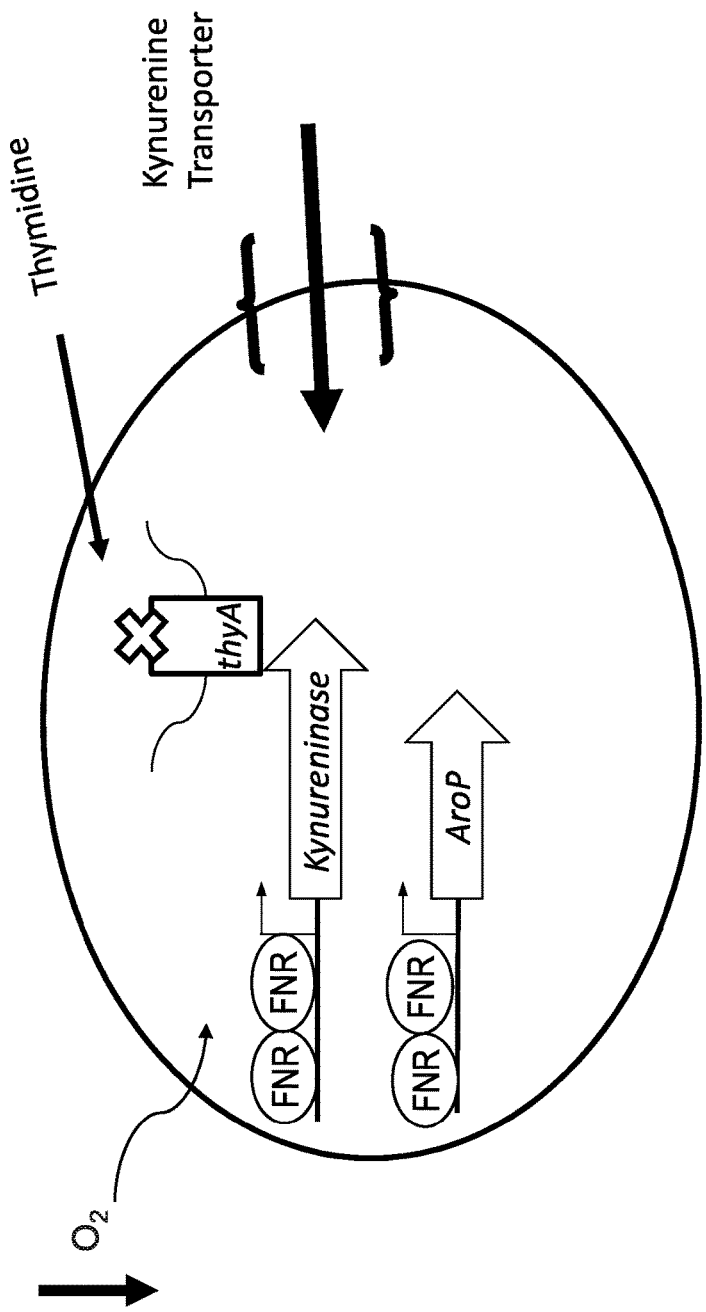

FIG. 44 shows a schematic depicting an exemplary Kynurenine Degradation Circuit. Kynurenine is imported into the cell through expression of the aroP, tnaB or mtr transporter. Kynureninase is expressed to metabolize Kynurenine to Anthranilic acid in the cell. Both the transporter and kynureninase genes are optionally expressed from an inducible promoter, e.g., a FNR-inducible promoter. In other embodiments, the FNR promoter may be replaced or combined with one inducible promoter known in the art or described herein. In some embodiments, the promoter is a constitutive promoter, described herein or known in the art. The microorganism may also include an auxotrophy, e.g., deletion of thyA (A thyA). Non-limiting example of a bacterial strain is listed.

Figure 45:
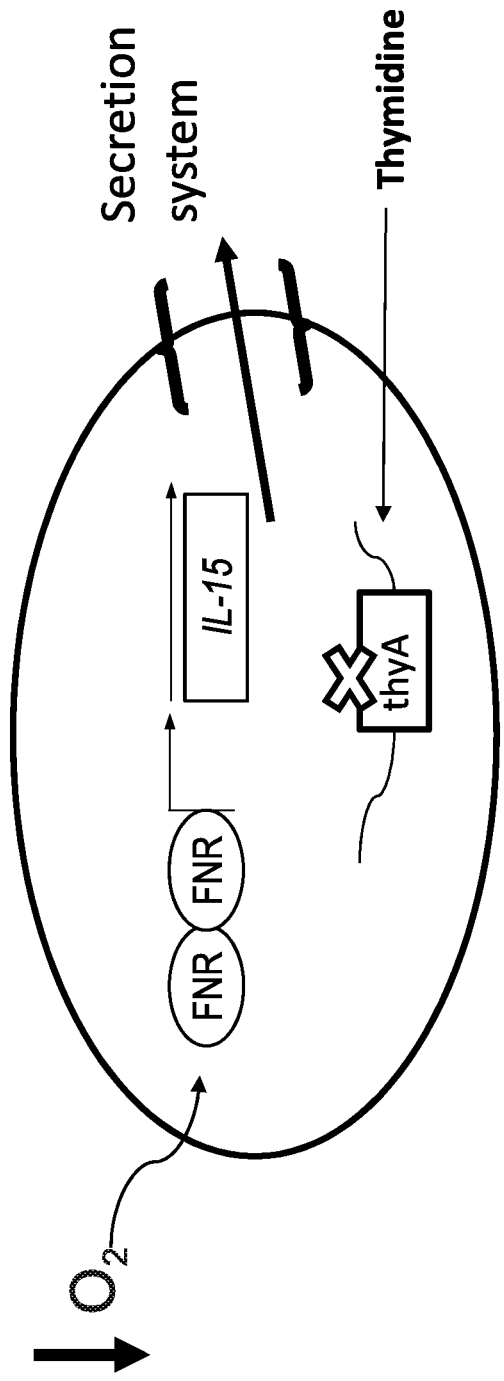

FIG. 45 shows a schematic depicting an exemplary microorganism having a non-native secretion system used to secrete a therapeutic peptide (e.g., IL-15). The bacteria may also include an auxotrophy, e.g., deletion of thyA (Δ thyA; thymidine dependence). Non-limiting examples of bacterial strains are listed. An inducible promoter, e.g., FNR-inducible promoter is optionally used to drive the expression of the therapeutic peptide or protein. In other embodiments, the FNR promoter may be replaced or combined with one inducible promoter known in the art or described herein. In some embodiments, the promoter is a constitutive promoter, described herein or known in the art. The microorganism may also include an auxotrophy, e.g., deletion of thyA (Δ thyA). Secretion system refers to a native or non-native secretion mechanism capable of secreting the anti-cancer molecule from the cytoplasm of the microorganism. Non-limiting examples of secretion systems include the type I, type II, type III, type IV, type V, type VI, and type VII secretion systems, resistance-nodulation-division (RND) multi-drug efflux pumps, various single membrane secretion systems, and Sec and TAT secretion systems.

Figure 46:
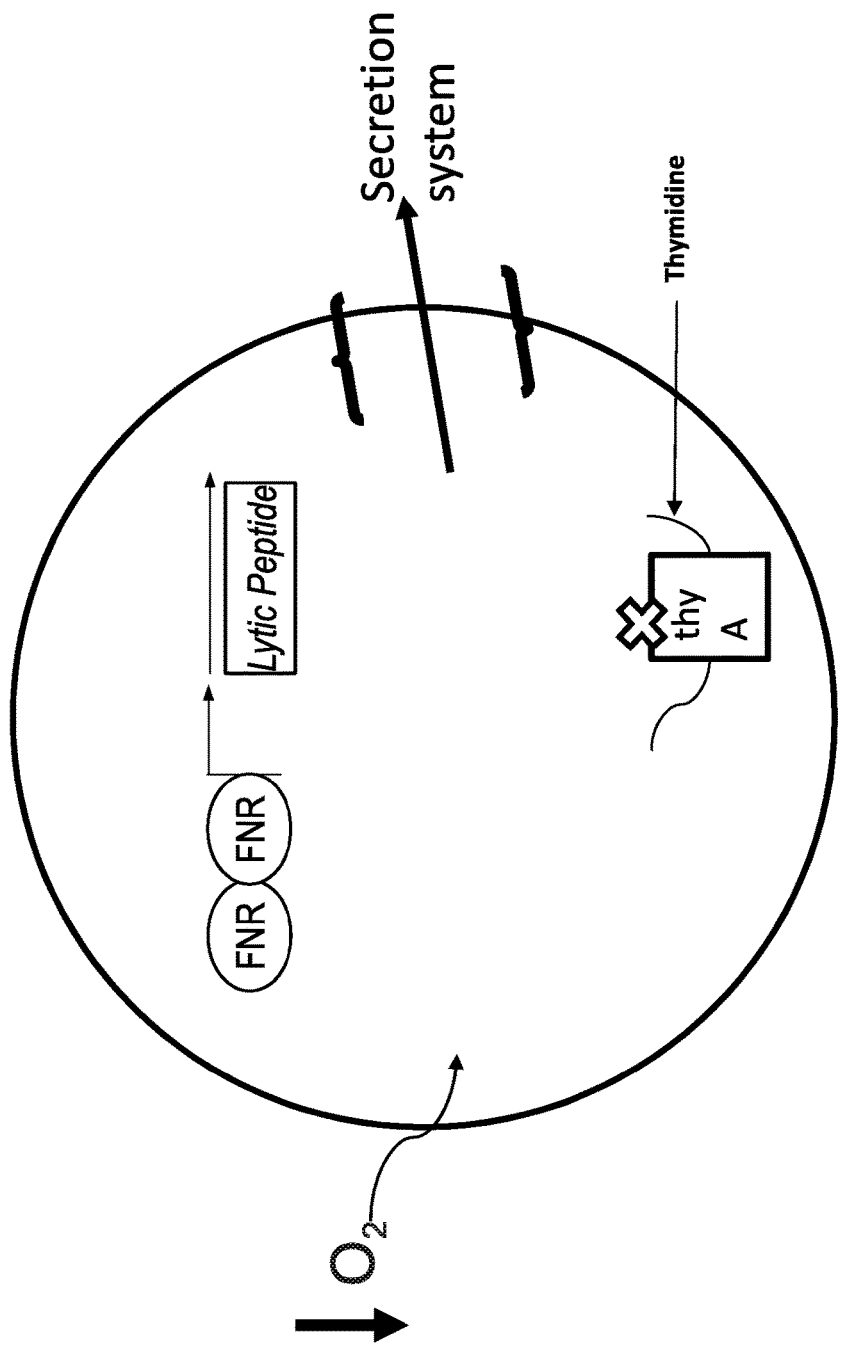

FIG. 46 shows a schematic depicting an exemplary microorganism having a non-native secretion system used to secrete a lytic peptide. An inducible promoter, e.g., FNR-inducible promoter is optionally used to drive the expression of the lytic peptide. In other embodiments, the FNR promoter may be replaced or combined with one inducible promoter known in the art or described herein. In some embodiments, the promoter is a constitutive promoter, described herein or known in the art. The microorganism may also include an auxotrophy, e.g., deletion of thyA (Δ thyA). In some embodiments, the promoter is a constitutive promoter, described herein or known in the art. The microorganisms may also include an auxotrophy, e.g., deletion of thyA (Δ thyA; thymidine dependence). Non-limiting examples of bacterial strains are listed. SEC Complex refers to a native secretion mechanism (e.g., gram positive bacteria) or non-native secretion mechanism (e.g., gram negative bacteria) that is capable of secreting the anti-cancer molecule from the cytoplasm of the microorganism. Secretion system refers to a native or non-native secretion mechanism capable of secreting the anti-cancer molecule from the cytoplasm of the microorganism. Non-limiting examples of secretion systems for gram negative bacteria include the type III, type I (e.g., hemolysin secretion system), type II, type IV, type V, type VI, and type VII secretion systems, resistance-nodulation-division (RND) multi-drug efflux pumps, and/or various single membrane secretion systems. Non-liming examples of secretion systems for gram positive bacteria include Sec and TAT secretion systems.

Figure 47:
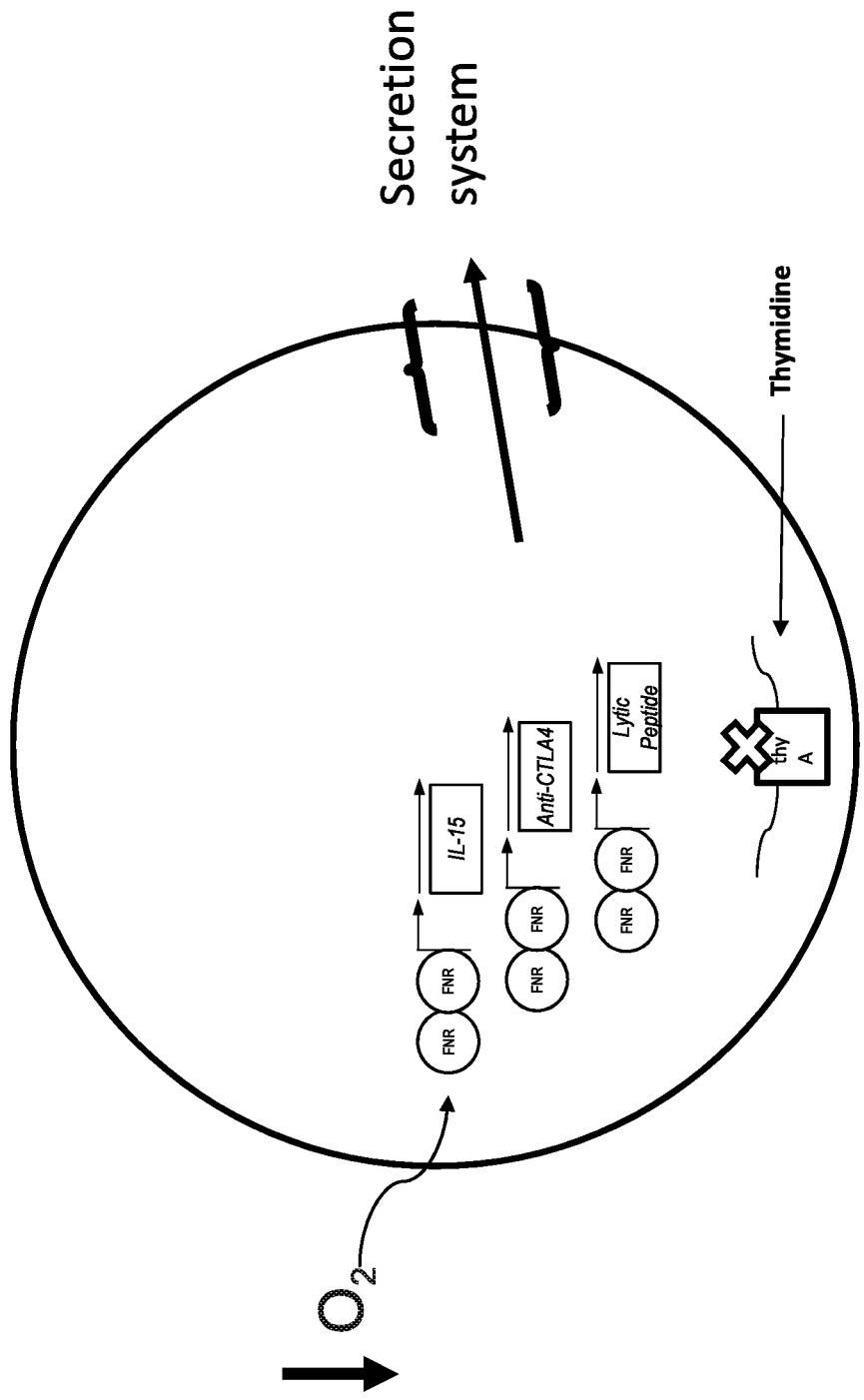

FIG. 47 shows a schematic depicting an exemplary microorganism having a non-native secretion system used to secrete two therapeutic peptides (IL-15 and anti-CTLA-4) and a lytic peptide. An inducible promoter, e.g., a FNR-inducible promoter is optionally used to drive the expression of therapeutic peptides. In other embodiments, the FNR promoter may be replaced or combined with one inducible promoter known in the art or described herein. In some embodiments, the promoter is a constitutive promoter, described herein or known in the art. The microorganism may also include an auxotrophy, e.g., deletion of thyA (Δ thyA). The microorganisms may also include an auxotrophy, e.g., deletion of thyA (Δ thyA; thymidine dependence). Non-limiting examples of microorganisms, including bacterial strains, are listed. Secretion system refers to a native or non-native secretion mechanism capable of secreting the anti-cancer molecule from the cytoplasm of the microorganism. Non-limiting examples of secretion systems for gram negative bacteria include the type III (e.g., modified with incomplete flagellum), type I (e.g., hemolysin secretion system), type II, type IV, type V, type VI, and type VII secretion systems, resistance-nodulation-division (RND) multi-drug efflux pumps, and/or various single membrane secretion systems. Non-liming examples of secretion systems for gram positive bacteria include Sec and TAT secretion systems.

Figure 48:
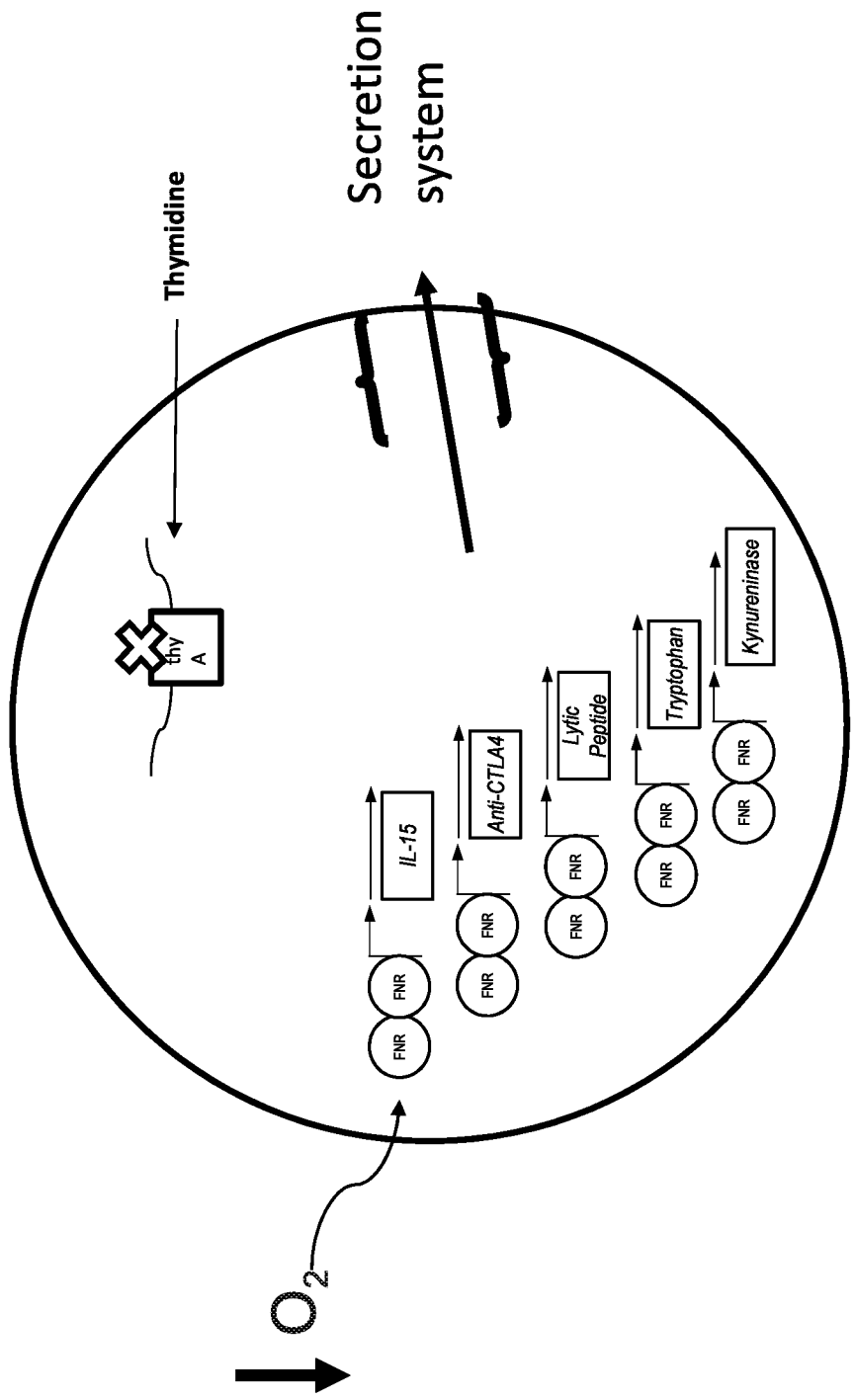

FIG. 48 shows a schematic depicting an exemplary microorganism having a non-native secretion system used to secrete various therapeutic peptides (IL-15, anti-CTLA-4, and kynureninase) and a lytic peptide. The bacterium is further capable of producing tryptophan. Kynureninase may optionally be expressed in the bacteria but not secreted to allow for the bacterium to consume and degrade kynurenine. An inducible promoter, e.g., a FNR-inducible promoter is optionally used to drive the expression of these peptides. In other embodiments, the FNR promoter may be replaced or combined with one inducible promoter known in the art or described herein. In some embodiments, the promoter is a constitutive promoter, described herein or known in the art. The microorganism may also include an auxotrophy, e.g., deletion of thyA (Δ thyA). The bacteria may also include an auxotrophy, e.g., deletion of thyA (Δ thyA; thymidine dependence). Non-limiting examples of microorganisms, including bacterial strains, are listed. Secretion system refers to a native or non-native secretion mechanism capable of secreting the anti-cancer molecule from the bacterial cytoplasm. Non-limiting examples of secretion systems for gram negative bacteria include the type III (e.g., modified with incomplete flagellum), type I (e.g., hemolysin secretion system), type II, type IV, type V, type VI, and type VII secretion systems, resistance-nodulation-division (RND) multi-drug efflux pumps, various single membrane secretion systems. Non-liming examples of secretion systems for gram positive bacteria include Sec and TAT secretion systems.

Figure 49:
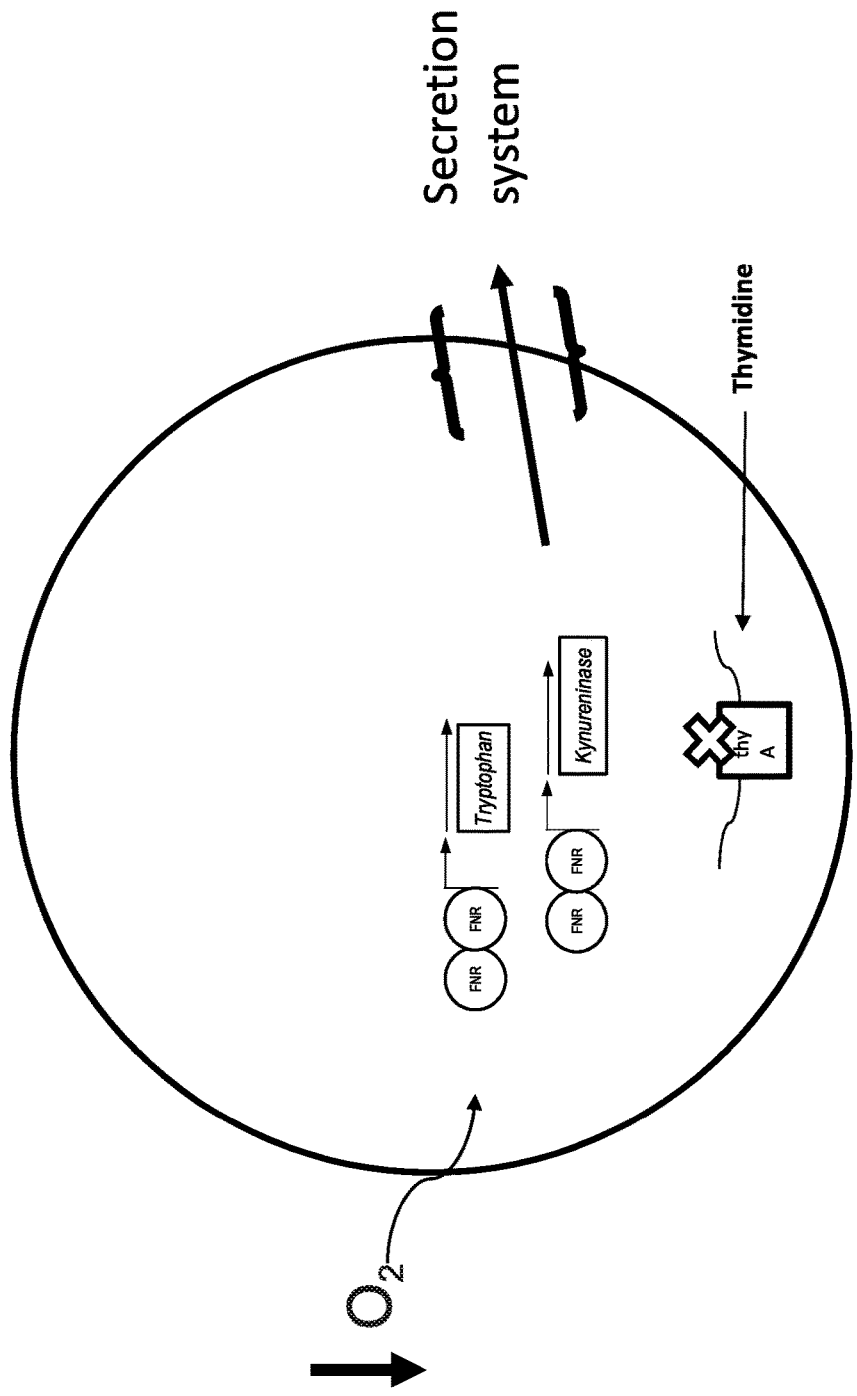

FIG. 49 shows a schematic depicting an exemplary microorganism having a non-native secretion system used to secrete a therapeutic peptide (kynureninase). Kynureninase may optionally be expressed in the bacteria but not secreted to allow for the bacterium to consume and degrade kynurenine. The bacterium is further capable of producing tryptophan. An inducible promoter, e.g., a FNR-inducible promoter is optionally used to drive the expression of these peptides. In other embodiments, the FNR promoter may be replaced or combined with one inducible promoter known in the art or described herein. In some embodiments, the promoter is a constitutive promoter, described herein or known in the art. The microorganism may also include an auxotrophy, e.g., deletion of thyA (Δ thyA). The bacteria may also include an auxotrophy, e.g., deletion of thyA (Δ thyA; thymindine dependence). Non limiting examples of bacterial strains are listed. Secretion system refers to a native or non-native secretion mechanism capable of secreting the anti-cancer molecule from the bacterial cytoplasm. Non-limiting examples of secretion systems for gram negative bacteria include the type III, type I (e.g., hemolysin secretion system), type II, type IV, type V, type VI, and type VII secretion systems, resistance-nodulation-division (RND) multi-drug efflux pumps, various single membrane secretion systems. Non-liming examples of secretion systems for gram positive bacteria include Sec and TAT secretion systems.

Figure 50:
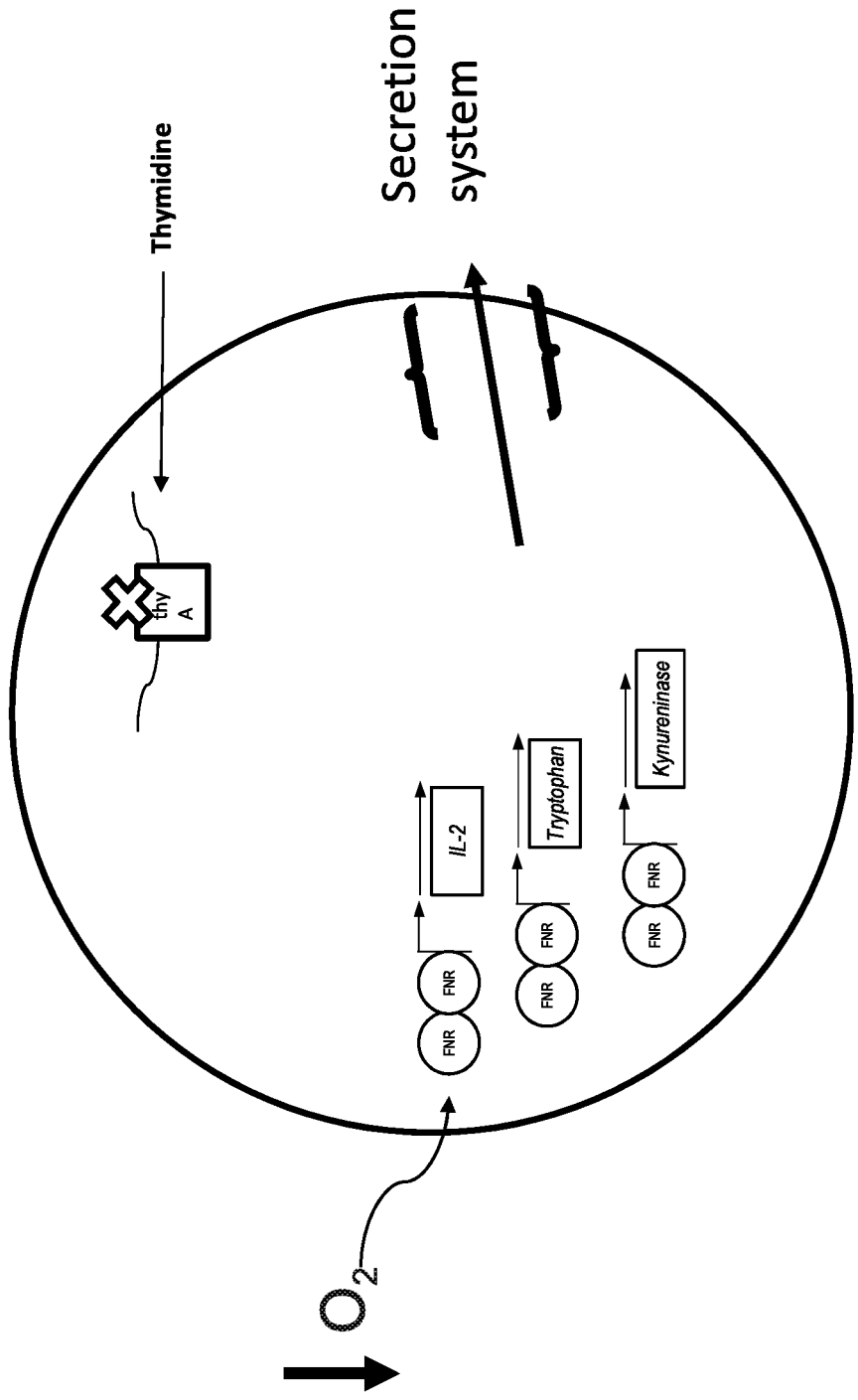

FIG. 50 shows a schematic depicting an exemplary microorganism having a non-native secretion system used to secrete two therapeutic peptides (IL-2 and kynureninase). Kynureninase may optionally be expressed in the bacteria but not secreted to allow for the bacterium to consume and degrade kynurenine. The bacterium is further optionally capable of producing tryptophan. An inducible promoter, e.g., a FNR-inducible promoter is optionally used to drive the expression of these peptides. In other embodiments, the FNR promoter may be replaced or combined with one inducible promoter known in the art or described herein. In some embodiments, the promoter is a constitutive promoter, described herein or known in the art. The microorganism may also include an auxotrophy, e.g., deletion of thyA (Δ thyA). The bacteria may also include an auxotrophy, e.g., deletion of thyA (Δ thyA; thymindine dependence). Non-limiting example of bacterial strains are listed. Secretion system refers to a native or non-native secretion mechanism capable of secreting the anti-cancer molecule from the cytoplasm of the microorganism. Non-limiting examples of secretion systems for gram negative bacteria include the type, type I (e.g., hemolysin secretion system), type II, type IV, type V, type VI, and type VII secretion systems, resistance-nodulation-division (RND) multi-drug efflux pumps, various single membrane secretion systems. Non-liming examples of secretion systems for gram positive bacteria include Sec and TAT secretion systems.

Figure 51:
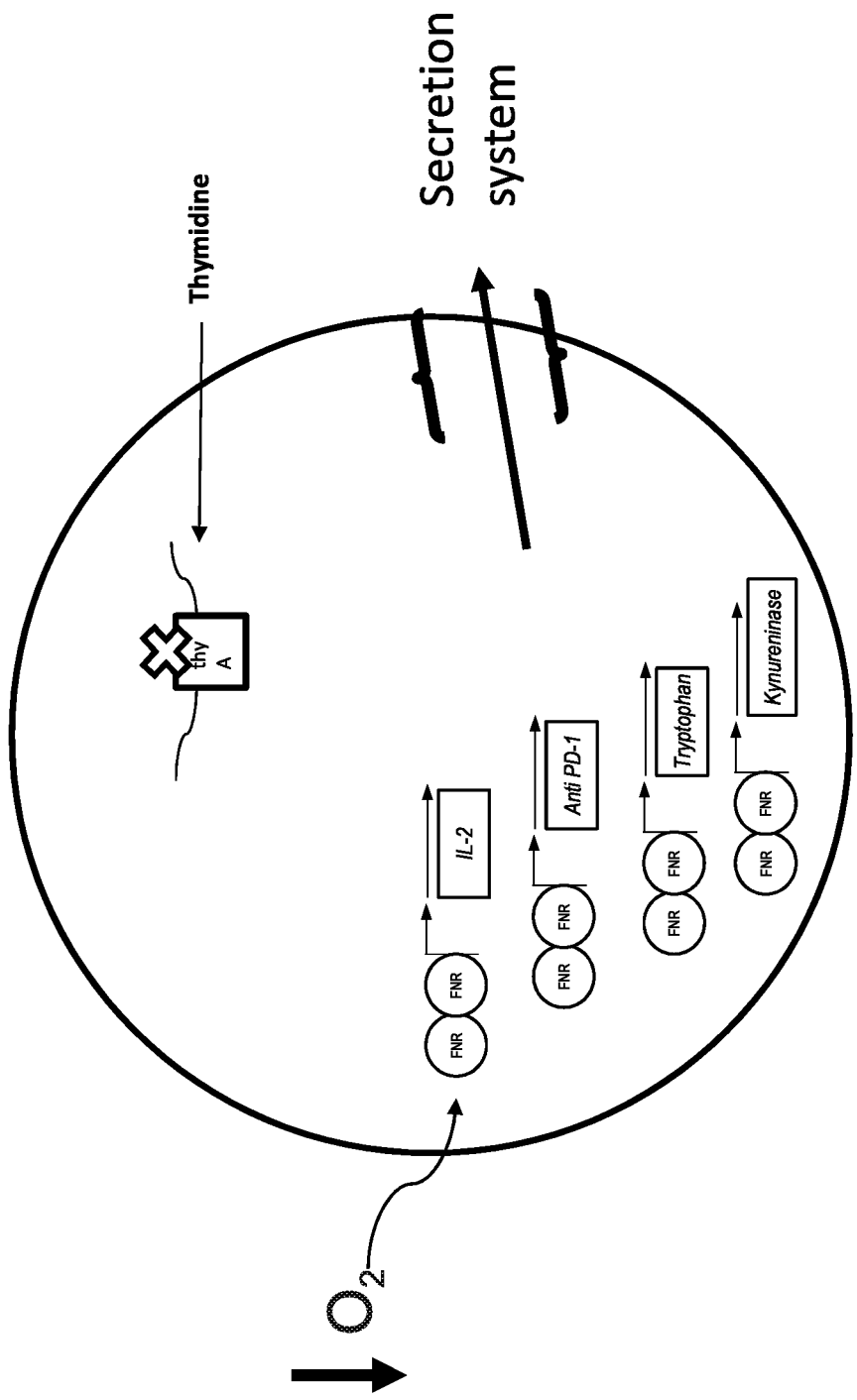

FIG. 51 shows a schematic depicting an exemplary microorganism having a non-native secretion system used to secrete various therapeutic peptides (IL-2, kynureninase, and anti-PD-1). Kynureninase may optionally be expressed in the bacteria but not secreted to allow for the bacterium to consume and degrade kynuerinine. The bacterium is further optionally capable of producing tryptophan. An inducible promoter, e.g., a FNR-inducible promoter is optionally used to drive the expression of these peptides. In other embodiments, the FNR promoter may be replaced or combined with one inducible promoter known in the art or described herein. In some embodiments, the promoter is a constitutive promoter, described herein or known in the art. The microorganism may also include an auxotrophy, e.g., deletion of thyA (Δ thyA). The bacteria may also include an auxotrophy, e.g., deletion of thyA (Δ thyA; thymindine dependence). Non-limiting examples of bacterial strains are listed. Secretion system refers to a native or non-native secretion mechanism capable of secreting the anti-cancer molecule from the cytoplasm of the microorganism. Non-limiting examples of secretion systems for gram negative bacteria include the type III, type I (e.g., hemolysin secretion system), type II, type IV, type V, type VI, and type VII secretion systems, resistance-nodulation-division (RND) multi-drug efflux pumps, various single membrane secretion systems. Non-liming examples of secretion systems for gram positive bacteria include Sec and TAT secretion systems.

FIG. 52 depicts an exemplary schematic of a chromosome of a microorganism, e.g, a bacterial chromosome, e.g., the *E. coli* 1917 Nissle chromosome, comprising multiple MoAs. In some embodiments, an immune stimulatory circuit, a checkpoint inhibitor circuit, and a metabolite modulator circuit are inserted at three different chromosomal insertion sites. The number of insertion and sites of insertion shown are not meant to be precise or limiting; they are illustrative and could be greater or fewer than three insertion sites and the sites may be dispersed across the microorganism genome.

FIG. 53 depicts an exemplary schematic of a chromosome of a microorganism, e.g, a bacterial chromosome, e.g., the *E. coli* 1917 Nissle chromosome, comprising multiple MoAs. In some embodiments, a cytotoxin circuit, an immune stimulatory circuit, a checkpoint inhibitor circuit, and a metabolite modulator circuit are inserted at four different chromosomal insertion sites. The number of insertion and sites of insertion shown are not meant to be precise or limiting; they are illustrative and could be greater or fewer than four insertion sites and the sites may be dispersed across the microorganism genome.

Figure 54:
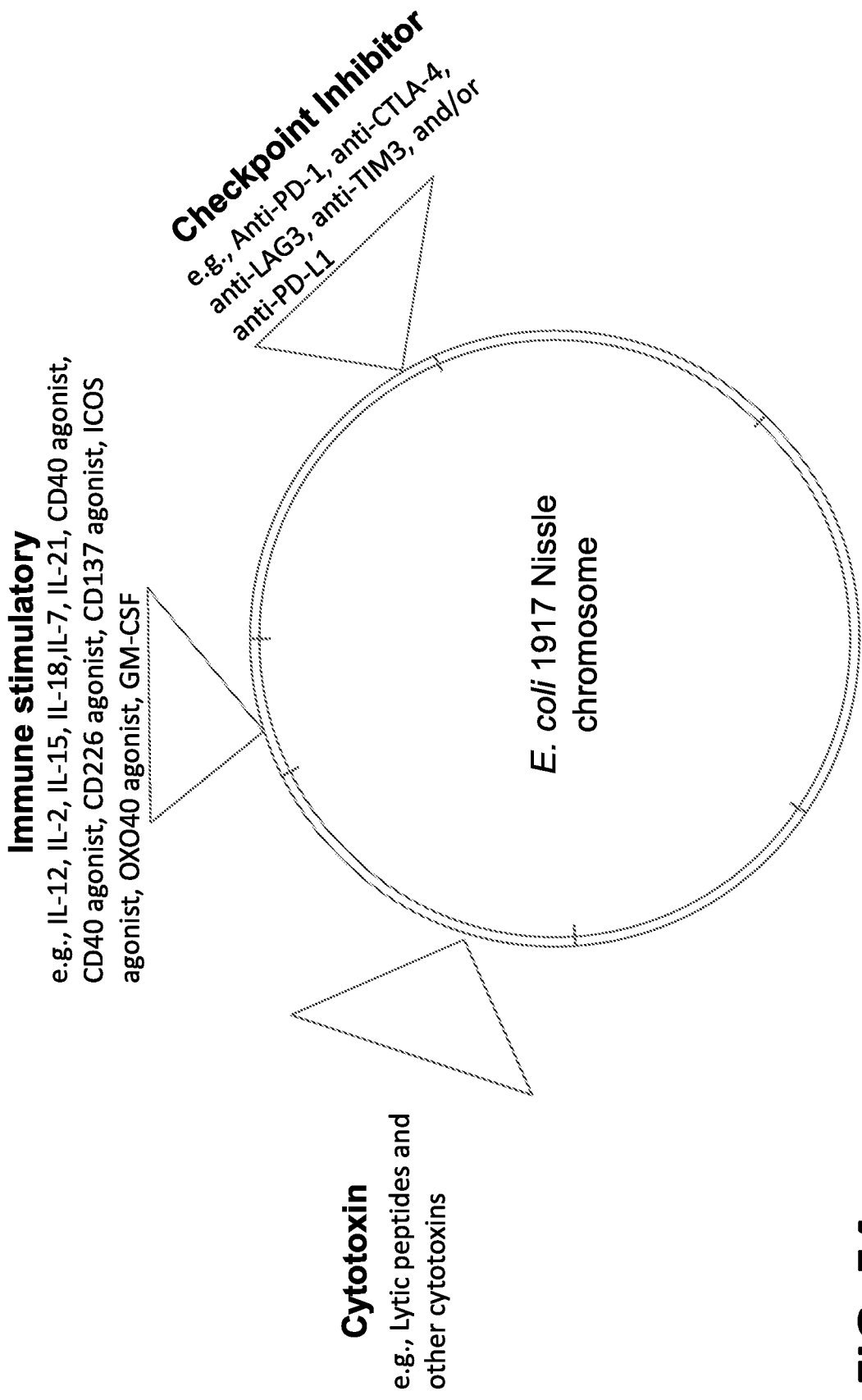

FIG. 54 depicts an exemplary schematic of a chromosome of a microorganism, e.g, a bacterial chromosome, e.g., the *E. coli* 1917 Nissle chromosome, comprising multiple MoAs. In some embodiments, a cytotoxin circuit, an immune stimulatory circuit, and a checkpoint inhibitor circuit are inserted at three different chromosomal insertion sites. The number of insertion and sites of insertion shown are not meant to be precise or limiting; they are illustrative and could be greater or fewer than three insertion sites and the sites may be dispersed across the microorganism genome.

Figure 55:
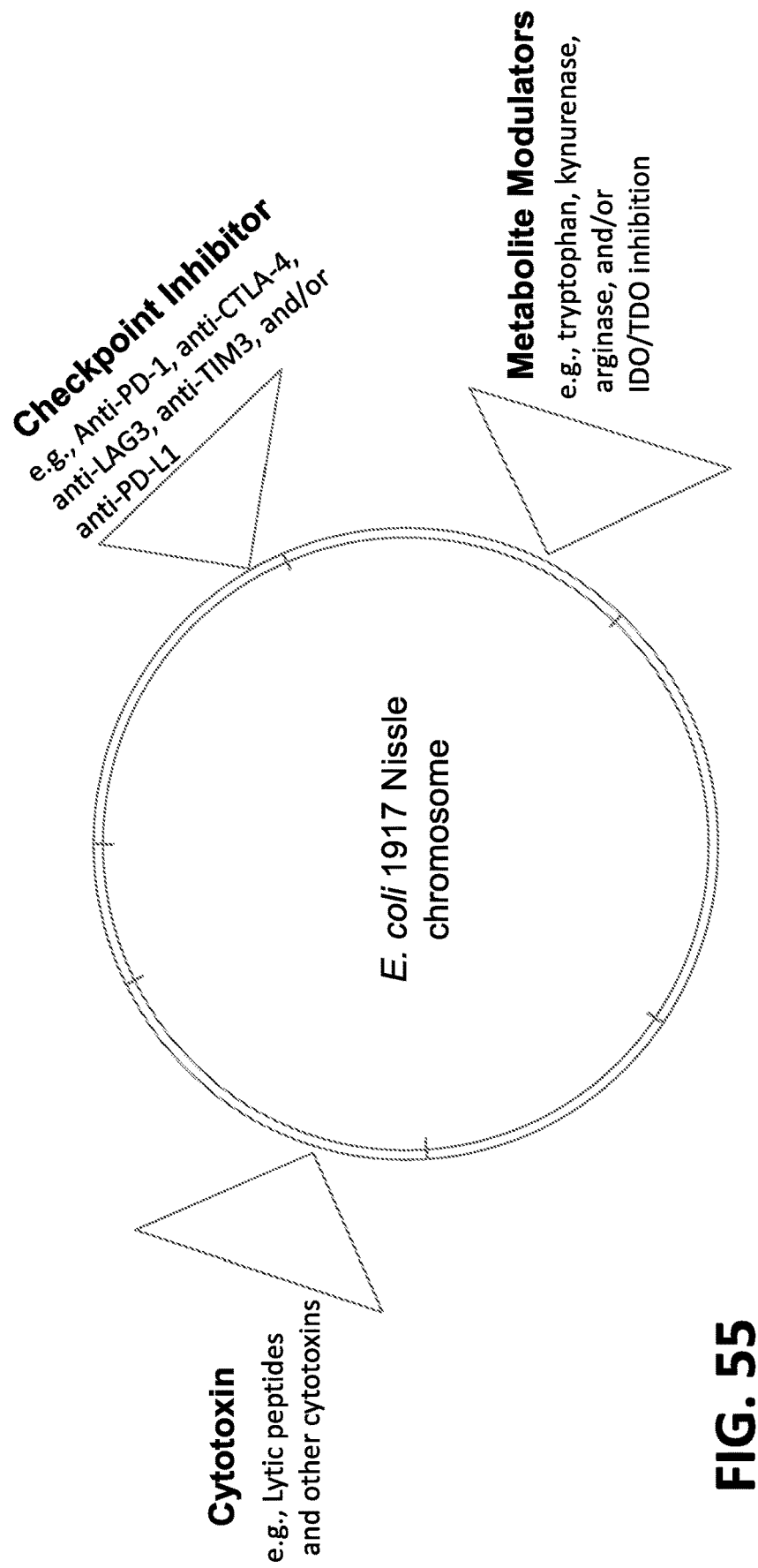

FIG. 55 depicts an exemplary schematic of a chromosome of a microorganism, e.g, a bacterial chromosome, e.g., the *E. coli* 1917 Nissle chromosome, the *E. coli* 1917 Nissle chromosome, comprising multiple MoAs. In some embodiments, a cytotoxin circuit, a checkpoint inhibitor circuit, and metabolite modulator circuit are inserted at three different chromosomal insertion sites. The number of insertion and sites of insertion shown are not meant to be precise or limiting; they are illustrative and could be greater or fewer than three insertion sites and the sites may be dispersed across the microorganism genome.

Figure 56:
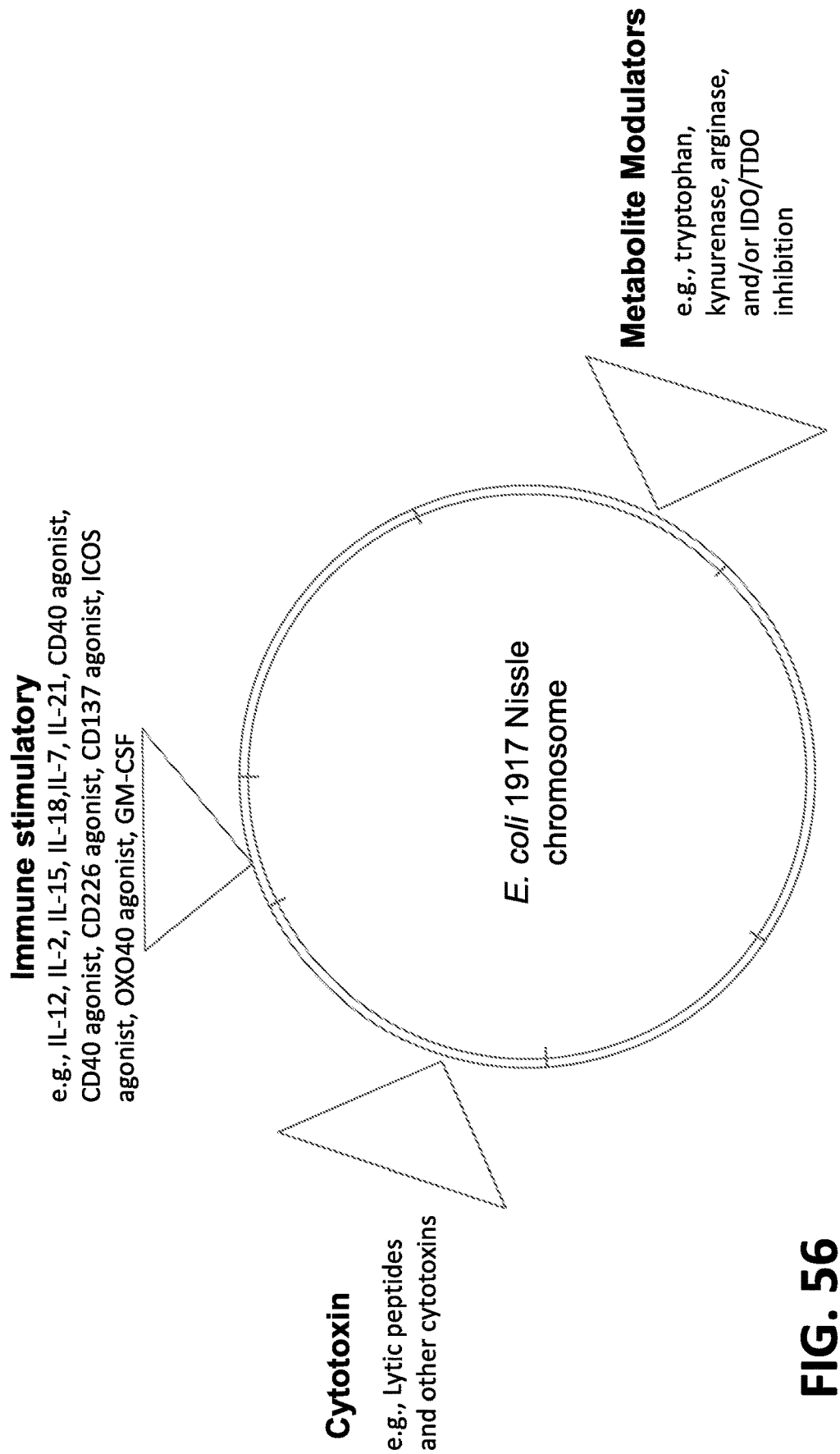

FIG. 56 depicts an exemplary schematic of a chromosome of a microorganism, e.g, a bacterial chromosome, e.g., the *E. coli* 1917 Nissle chromosome, comprising multiple MoAs. In some embodiments, a cytotoxin circuit, an immune stimulatory circuit, and a metabolite modulator circuit are inserted at three different chromosomal insertion sites. The number of insertion and sites of insertion shown are not meant to be precise or limiting; they are illustrative and could be greater or fewer than three insertion sites and the sites may be dispersed across the microorganism genome.

FIG. 57 depicts an exemplary schematic of a chromosome of a microorganism, e.g, a bacterial chromosome, e.g., the *E. coli* 1917 Nissle chromosome, comprising multiple MoAs. In some embodiments, an immune stimulatory circuit and a checkpoint inhibitor circuit are inserted at two different chromosomal insertion sites. The number of insertion and sites of insertion shown are not meant to be precise or limiting; they are illustrative and could be greater or fewer than two insertion sites and the sites may be dispersed across the microorganism genome.

Figure 58:
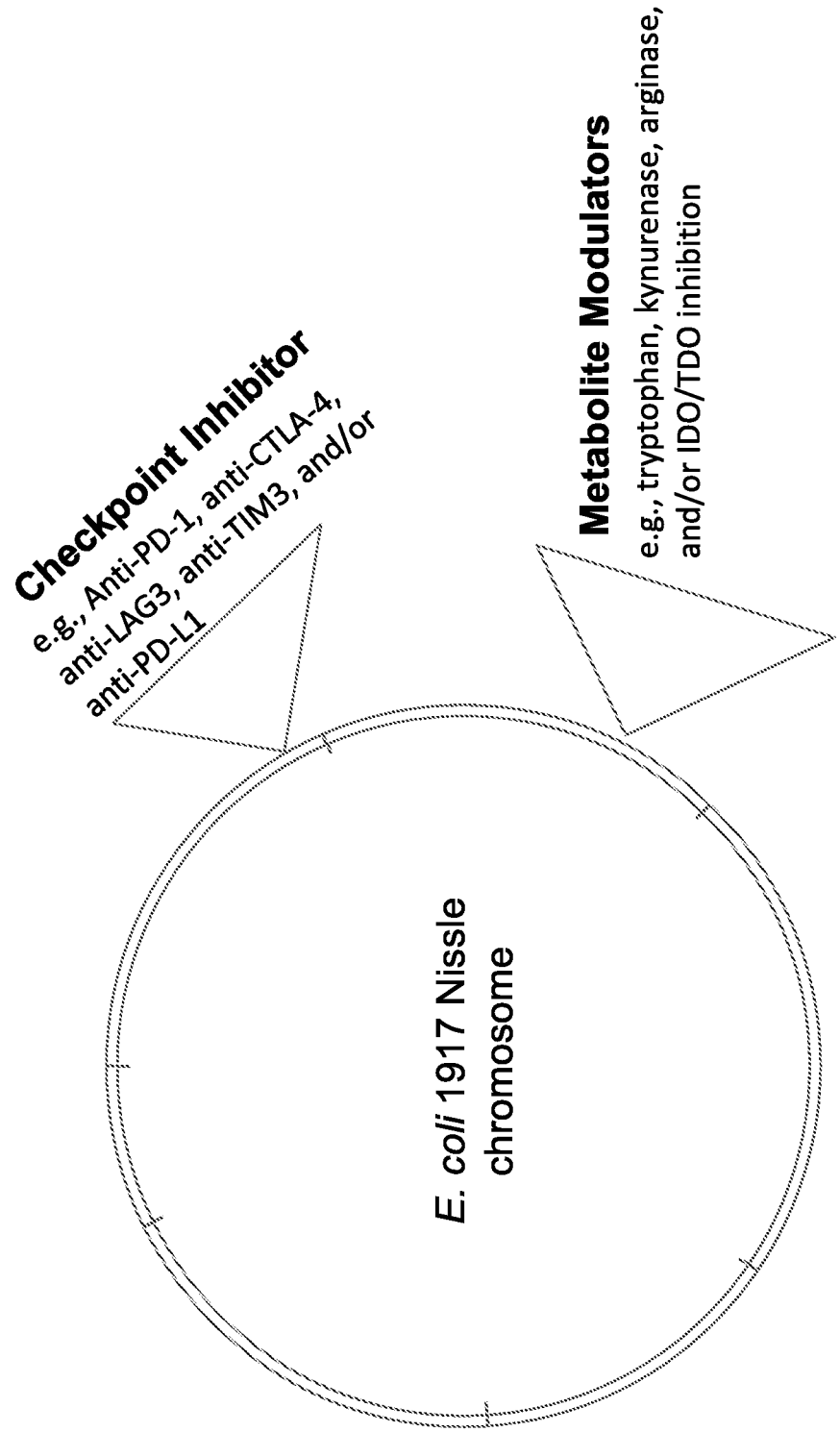

FIG. 58 depicts an exemplary schematic of a chromosome of a microorganism, e.g, a bacterial chromosome, e.g., the *E. coli* 1917 Nissle chromosome, the *E. coli* 1917 Nissle chromosome, comprising multiple MoAs. In some embodiments, a checkpoint inhibitor circuit and a metabolite modulator circuit are inserted at two different chromosomal insertion sites. The number of insertion and sites of insertion shown are not meant to be precise or limiting; they are illustrative and could be greater or fewer than two insertion sites and the sites may be dispersed across the microorganism genome.

FIG. 59 depicts an exemplary schematic of a chromosome of a microorganism, e.g, a bacterial chromosome, e.g., the *E. coli* 1917 Nissle chromosome comprising multiple MoAs. In some embodiments, an immune stimulatory circuit and a metabolite modulator circuit are inserted at two different chromosomal insertion sites. The number of insertion and sites of insertion shown are not meant to be precise or limiting; they are illustrative and could be greater or fewer than two insertion sites and the sites may be dispersed across the microorganism genome.

Figure 60:
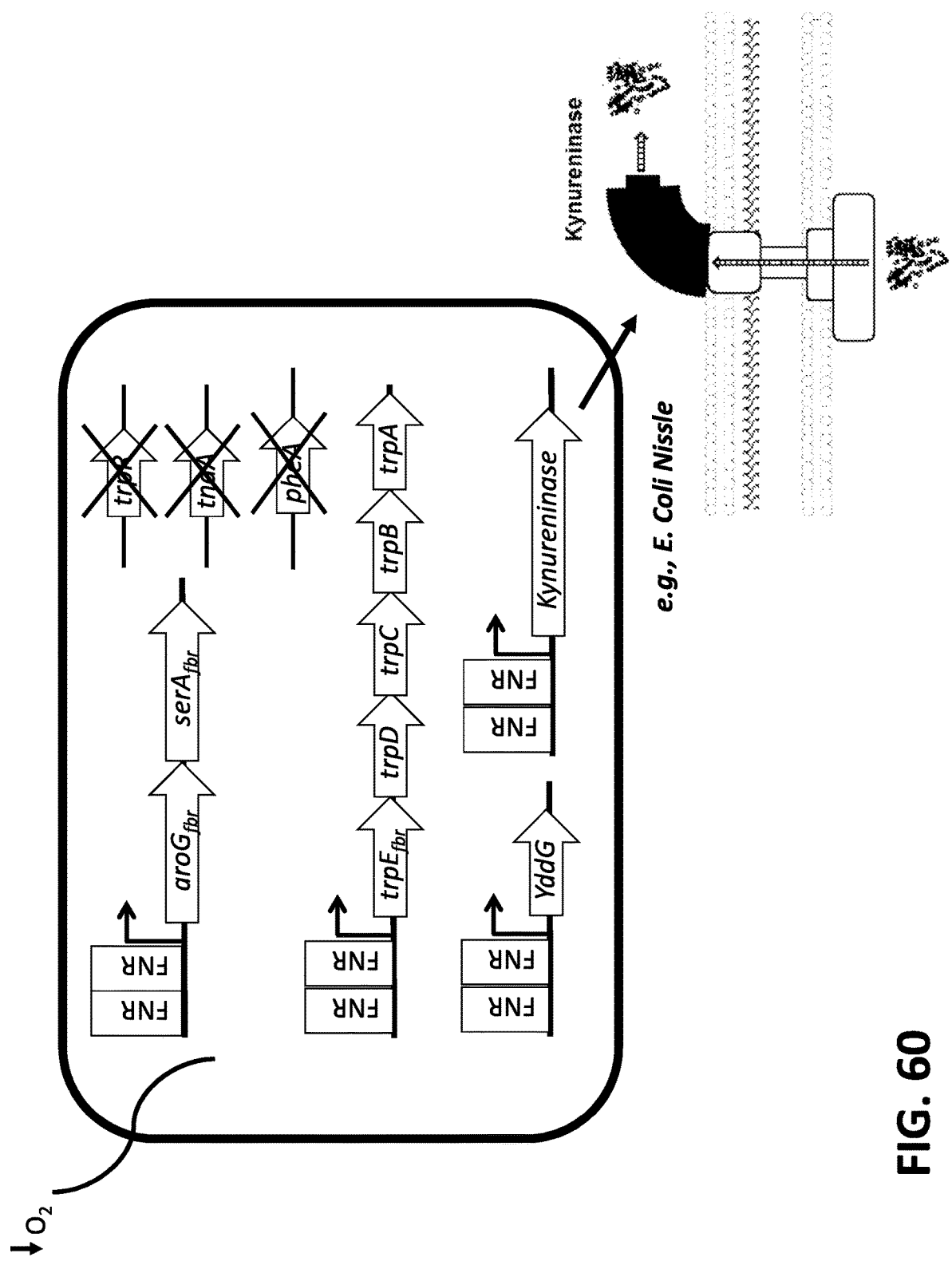

FIG. 60 depicts a schematic of a secretion system where kynureninase is secreted using a system for example similar to the system shown in FIG. 85. FIG. 60 also shows a schematic depicting an exemplary Tryptophan circuit. Any tryptophan circuit described herein, e.g., in FIG. 19A, FIG. 19B, FIG. 19C, and FIG. 19D, can be used. Non-limiting example of bacterial strains are listed.

Figure 61:
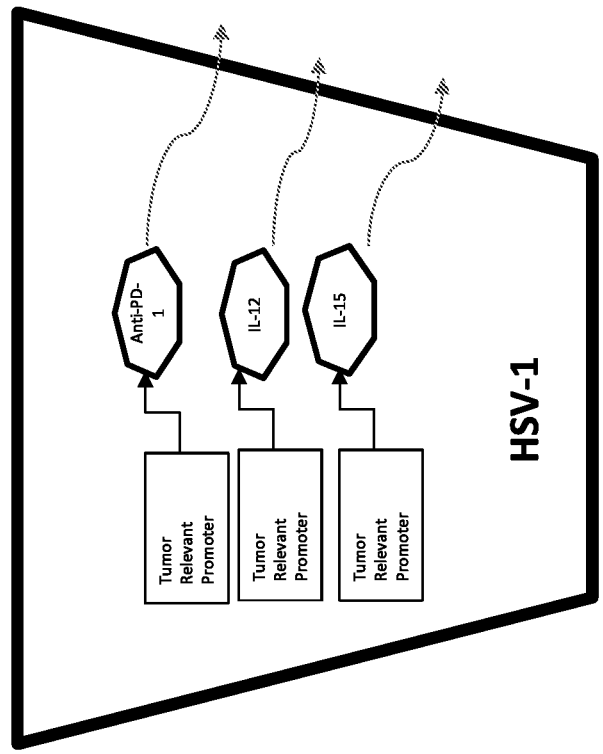

FIG. 61 shows a schematic depicting an Herpes simple virus (HSV-1) used to secrete therapeutic peptides, anti-PD-1, IL-12 and IL-15. The expression of the therapeutic peptides is under the control of a tumor relevant promoter.

Figure 62:
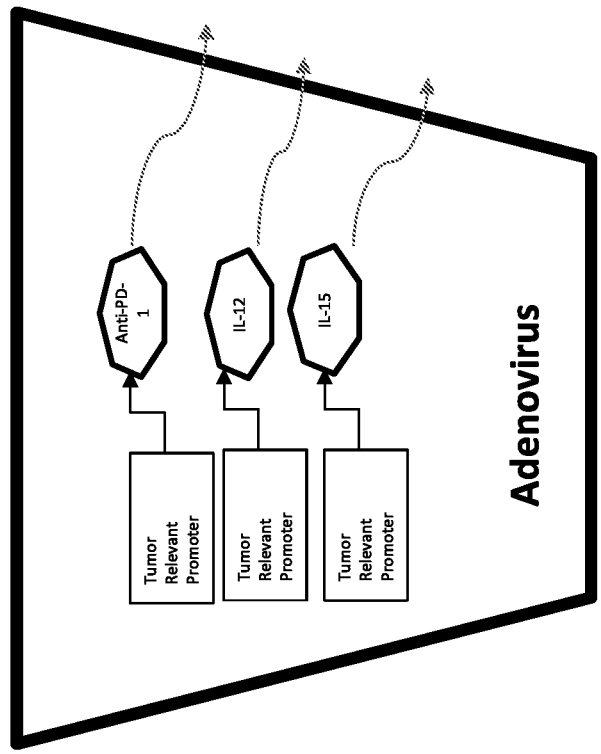

FIG. 62 depicts a schematic of an Adenovirus used to secrete therapeutic peptides, anti-PD-1, IL-12 and IL-15. The expression of the therapeutic peptides is under the control of a tumor relevant promoter.

Figure 63:
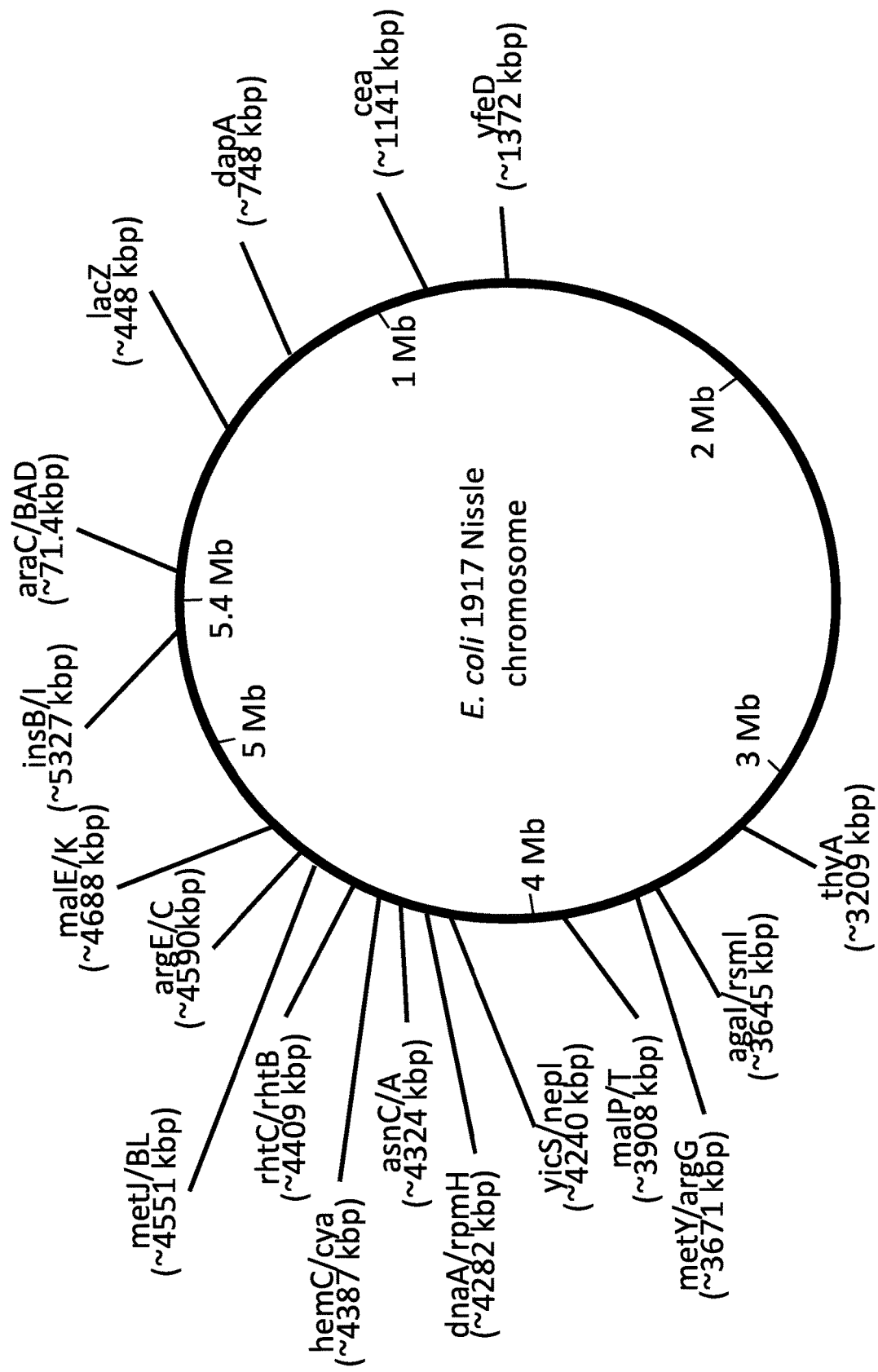

FIG. 63 depicts a map of exemplary integration sites within the *E. coli* 1917 Nissle chromosome. These sites indicate regions where circuit components may be inserted into the chromosome without interfering with essential gene expression. Backslashes (/) are used to show that the insertion will occur between divergently or convergently expressed genes. Insertions within biosynthetic genes, such as thyA, can be useful for creating nutrient auxotrophies. In some embodiments, an individual circuit component is inserted into more than one of the indicated sites.

Figure 64:
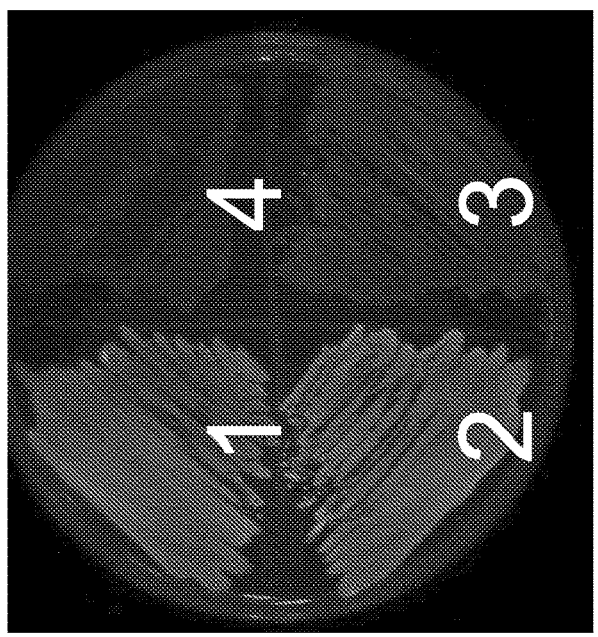

FIG. 64 depicts three bacterial strains which constitutively express red fluorescent protein (RFP). In strains 1-3, the rfp gene has been inserted into different sites within the bacterial chromosome, and results in varying degrees of brightness under fluorescent light. Unmodified *E. coli* Nissle (strain 4) is non-fluorescent.

Figure 65:
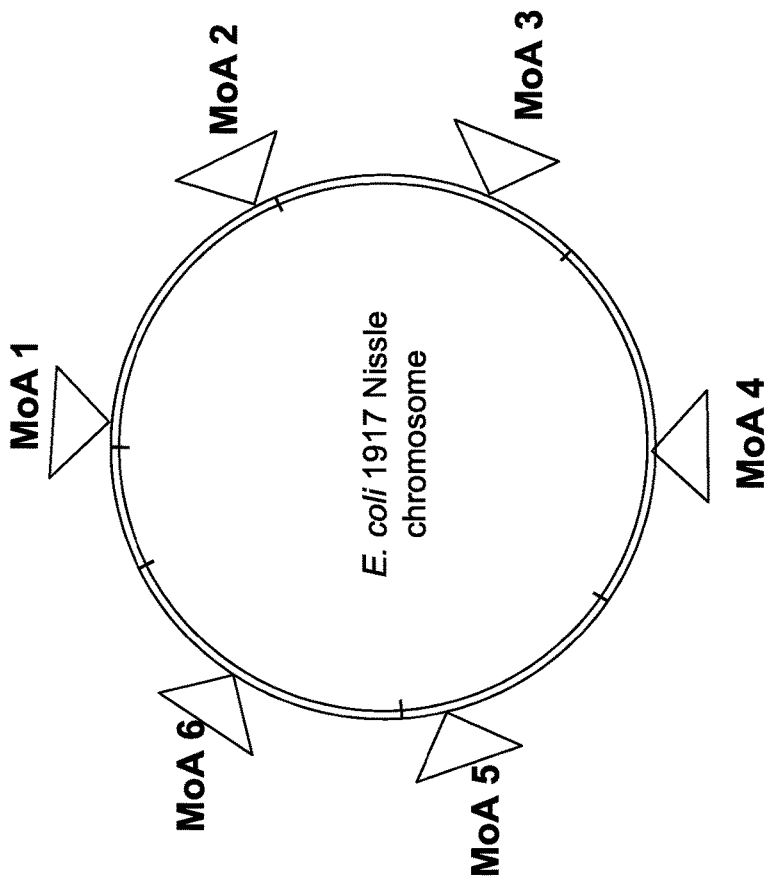

FIG. 65 depicts an exemplary schematic of the *E. coli* 1917 Nissle chromosome comprising multiple mechanisms of action (MoAs).

Figure 66:
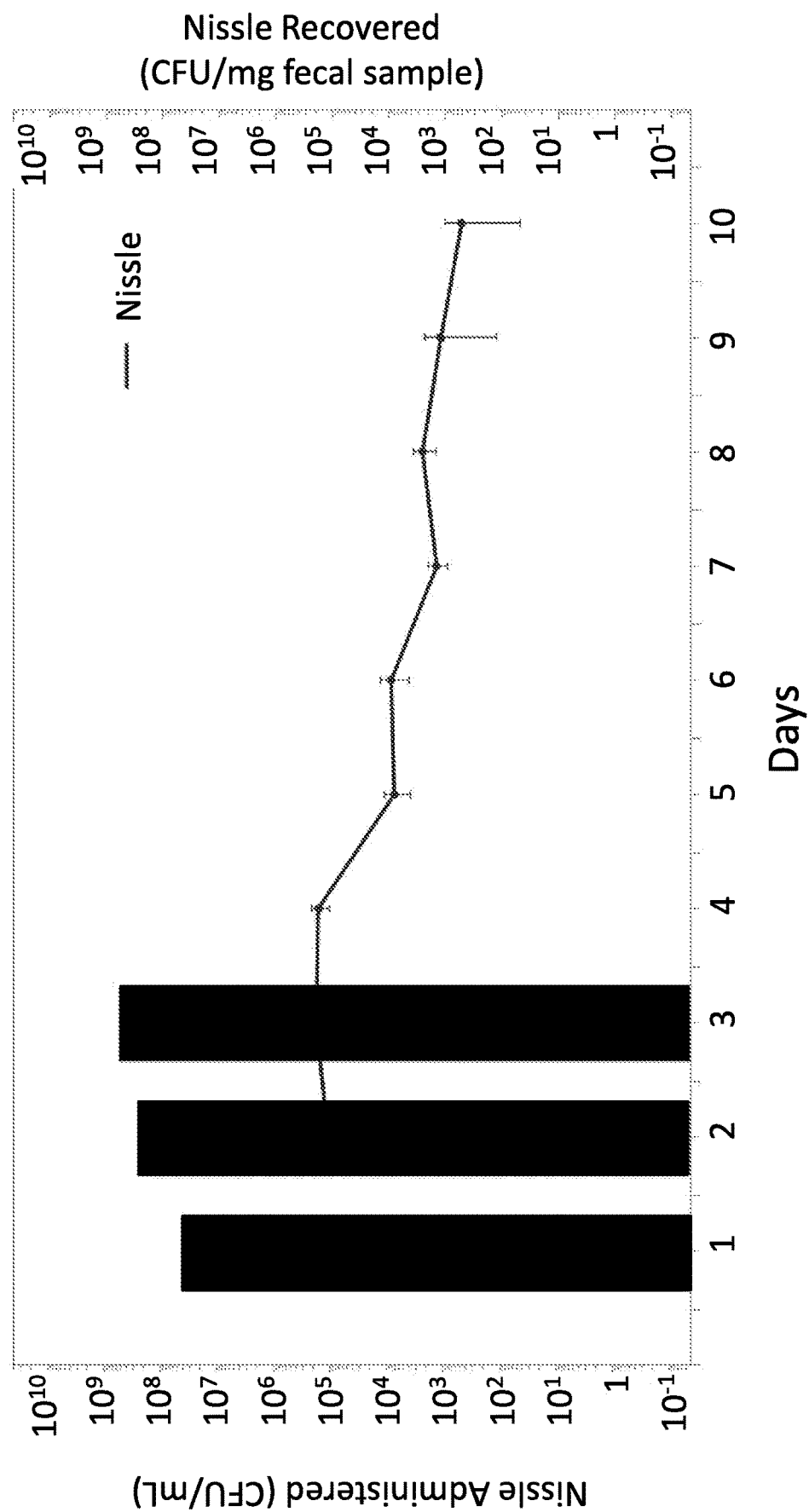

FIG. 66 depicts a graph of Nissle residence in vivo. Streptomycin-resistant Nissle was administered to mice via oral gavage without antibiotic pre-treatment. Fecal pellets from 6 total mice were monitored post-administration to determine the amount of administered Nissle still residing within the mouse gastrointestinal tract. The bars represent the number of bacteria administered to the mice. The line represents the number of Nissle recovered from the fecal samples each day for 10 consecutive days.

Figure 67:
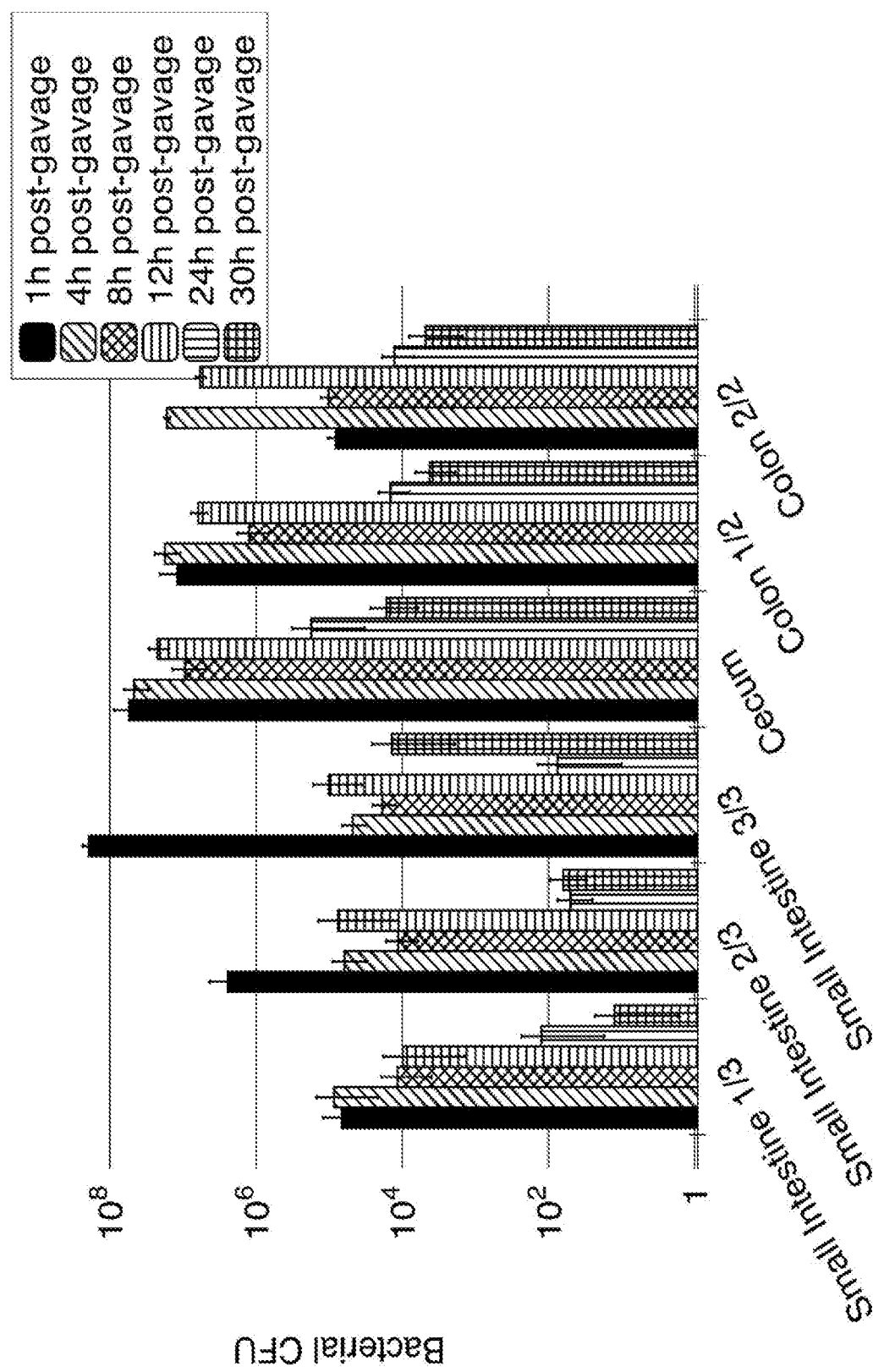

FIG. 67 depicts a bar graph of residence over time for streptomycin resistant Nissle in various compartments of the intestinal tract at 1, 4, 8, 12, 24, and 30 hours post gavage. Mice were treated with approximately 109 CFU, and at each timepoint, animals (n=4) were euthanized, and intestine, cecum, and colon were removed. The small intestine was cut into three sections, and the large intestine and colon each into two sections. Intestinal effluents gathered and CFUs in each compartment were determined by serial dilution plating.

Figure 68A:
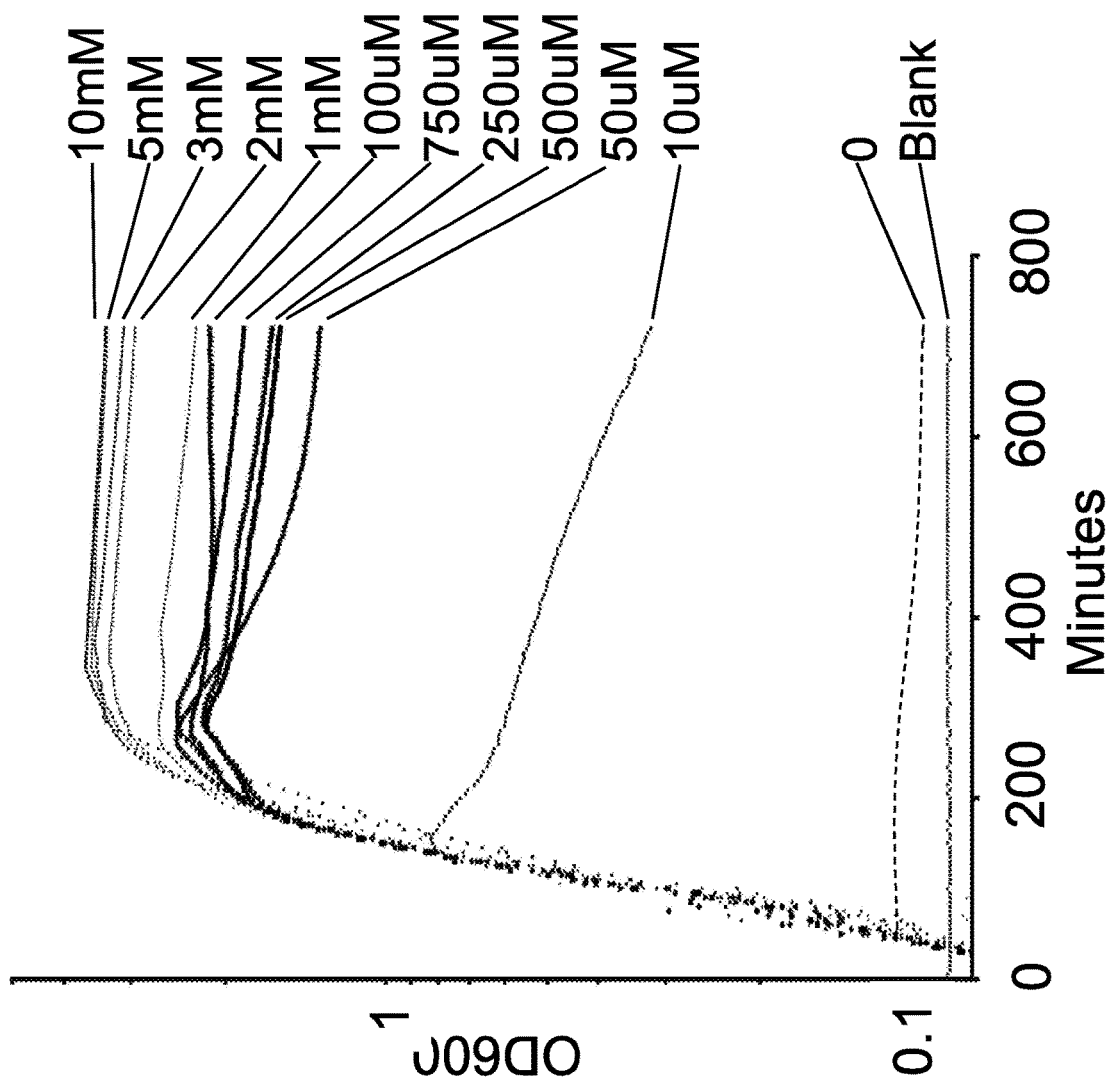

FIG. 68A depicts a graph showing bacterial cell growth of a Nissle thyA auxotroph strain (thyA knock-out) in various concentrations of thymidine. A chloramphenicol-resistant Nissle thyA auxotroph strain was grown overnight in LB+10 mM thymidine at 37 C. The next day, cells were diluted 1:100 in 1 mL LB+10 mM thymidine, and incubated at 37 C for 4 hours. The cells were then diluted 1:100 in 1 mL LB+varying concentrations of thymidine in triplicate in a 96-well plate. The plate is incubated at 37 C with shaking, and the OD600 is measured every 5 minutes for 720 minutes. This data shows that Nissle thyA auxotroph does not grow in environments lacking thymidine.

Figure 68B:
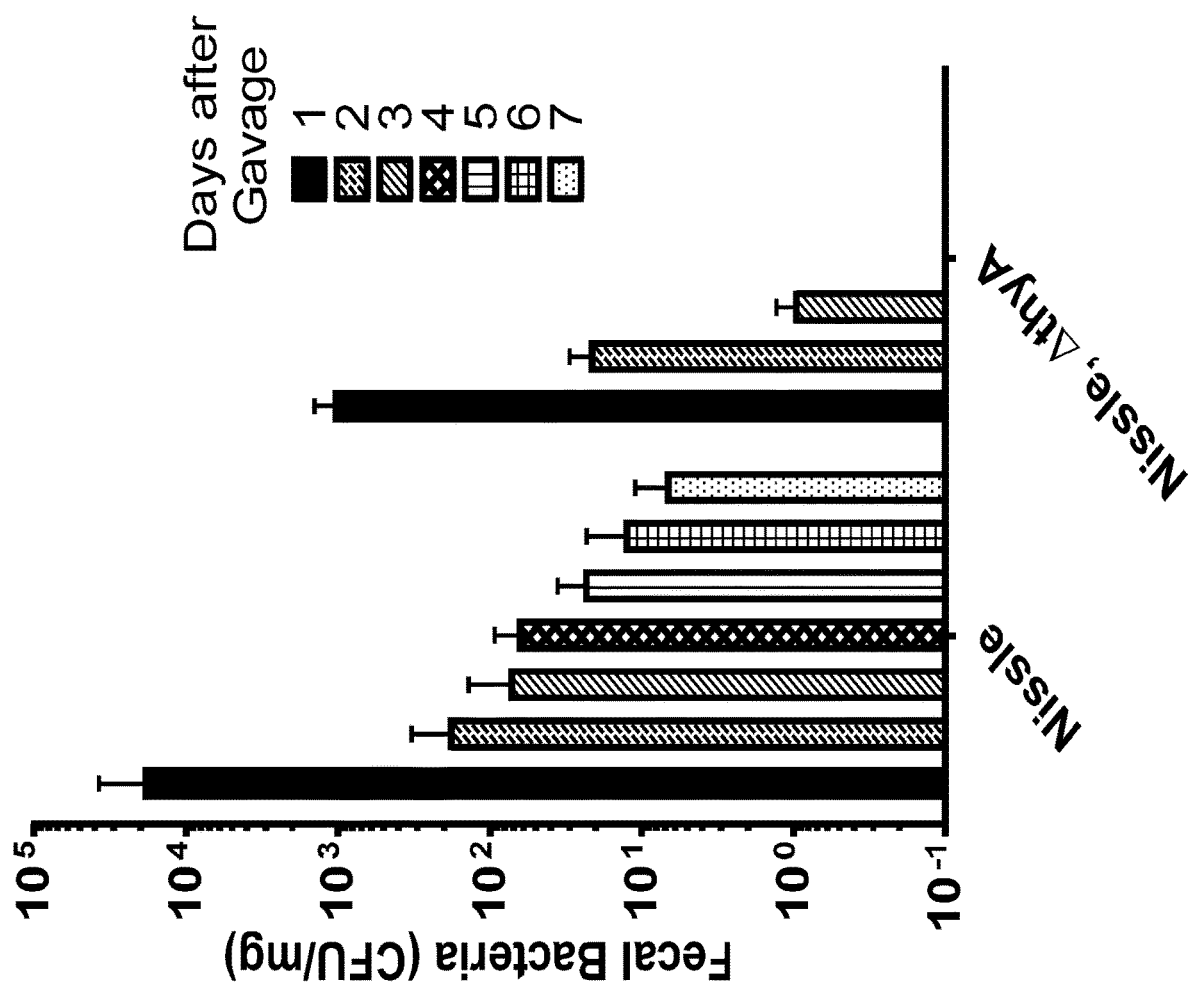

FIG. 68B depicts a bar graph of Nissle residence in vivo of wildtype Nissle versus Nissle thyA auxotroph (thyA knock-out). Streptomycin-resistant Nissle (wildtype or thyA auxotroph) was administered to mice via oral gavage without antibiotic pre-treatment. Fecal pellets from 6 total mice were monitored post-administration to determine the amount of administered Nissle still residing within the mouse gastrointestinal tract. Each bar represents the number of Nissle recovered from the fecal samples each day for 7 consecutive days. There were no bacteria recovered in fecal samples from mice gavaged with Nissle thyA auxotroph bacteria after day 3. This data shows that the Nissle thyA auxotroph does not persist in vivo in mice.

Figure 69A:
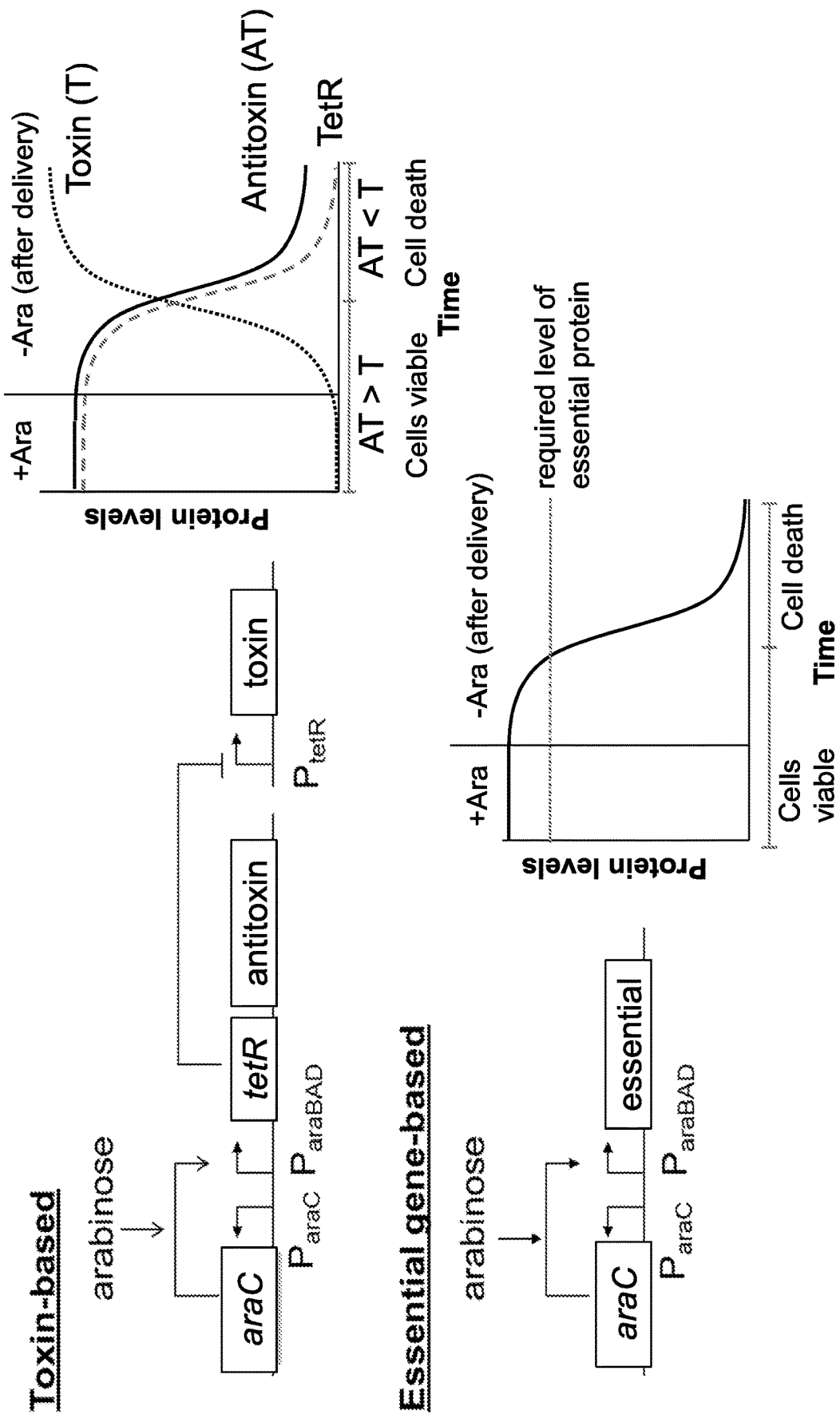
Figure 69B:
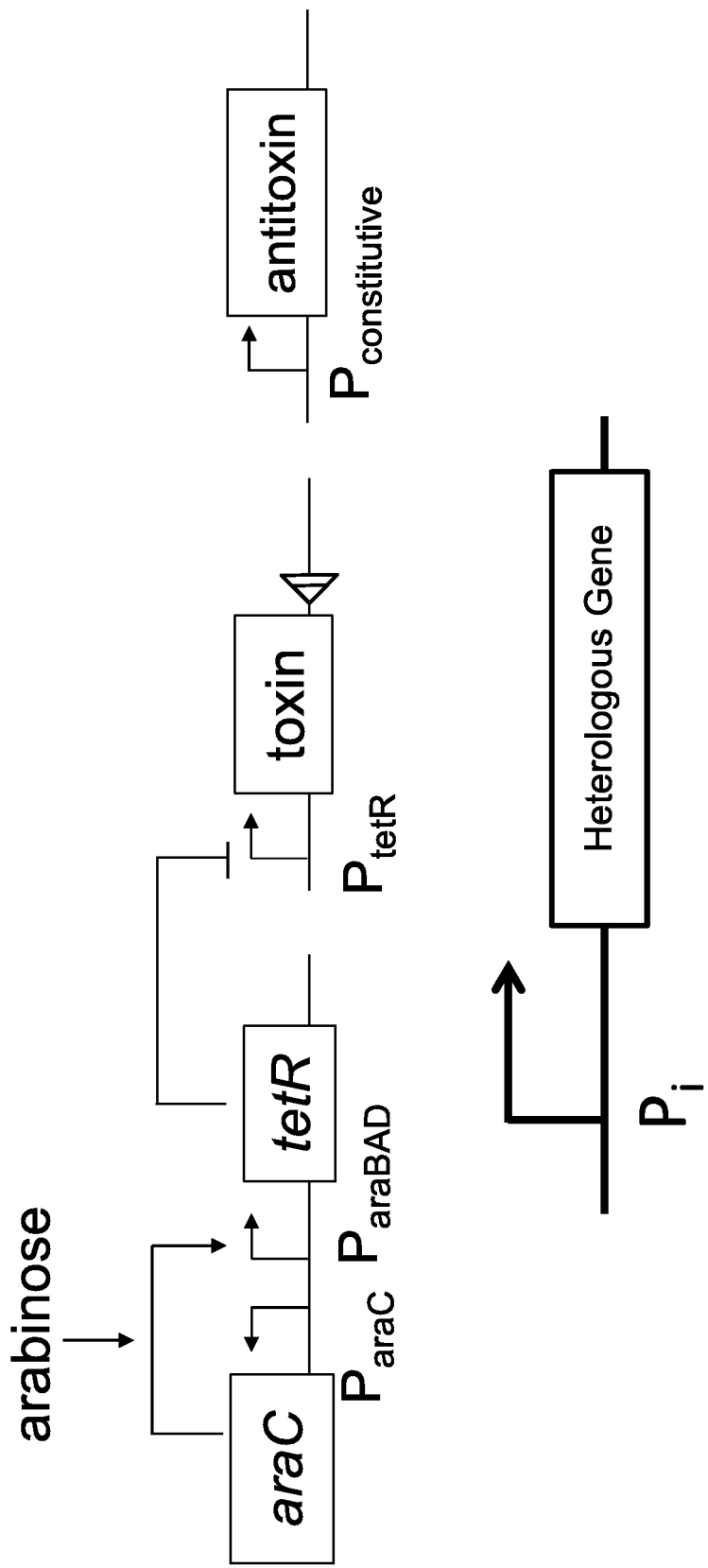
Figure 69C:
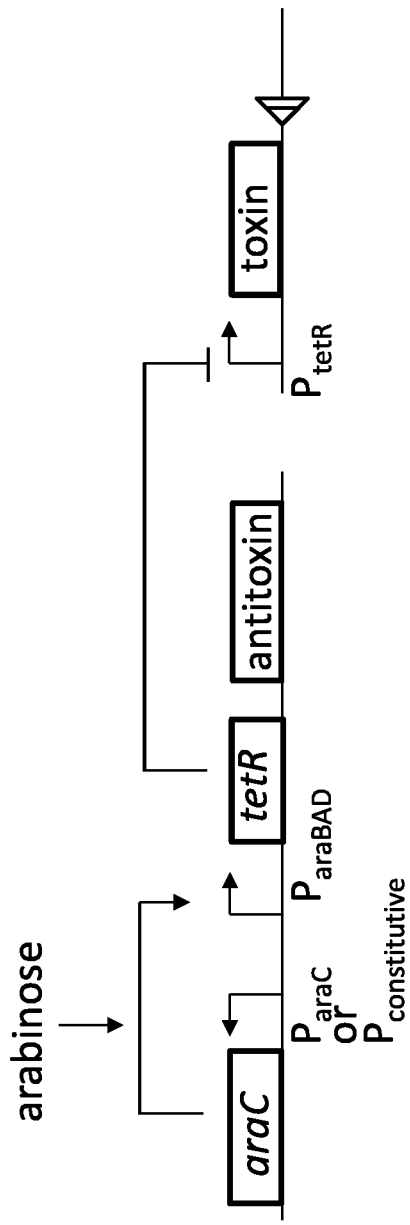

FIG. 69A, FIG. 69B, and FIG. 69C depict other non-limiting embodiments of the disclosure, wherein the expression of a heterologous gene is activated by an exogenous environmental signal. FIG. 69A depicts an embodiment of heterologous gene expression in which, in the absence of arabinose, the AraC transcription factor adopts a conformation that represses transcription. In the presence of arabinose, the AraC transcription factor undergoes a conformational change that allows it to bind to and activate the ParaBAD promoter ($P_{araBAD}$), which induces expression of the Tet repressor (TetR) and an anti-toxin. The anti-toxin builds up in the recombinant bacterial cell, while TetR prevents expression of a toxin (which is under the control of a promoter having a TetR binding site). However, when arabinose is not present, both the anti-toxin and TetR are not expressed. Since TetR is not present to repress expression of the toxin, the toxin is expressed and kills the cell. FIG. 69A also depicts another non-limiting embodiment of the disclosure, wherein the expression of an essential gene not found in the recombinant bacteria is activated by an exogenous environmental signal. In the absence of arabinose, the AraC transcription factor adopts a conformation that represses transcription of the essential gene under the control of the araBAD promoter and the bacterial cell cannot survive. In the presence of arabinose, the AraC transcription factor undergoes a conformational change that allows it to bind to and activate the araBAD promoter, which induces expression of the essential gene and maintains viability of the bacterial cell.

FIG. 69B depicts a non-limiting embodiment of the disclosure, where an anti-toxin is expressed from a constitutive promoter, and expression of a heterologous gene is activated by an exogenous environmental signal. In the absence of arabinose, the AraC transcription factor adopts a conformation that represses transcription. In the presence of arabinose, the AraC transcription factor undergoes a conformational change that allows it to bind to and activate the araBAD promoter, which induces expression of TetR, thus preventing expression of a toxin. However, when arabinose is not present, TetR is not expressed, and the toxin is expressed, eventually overcoming the anti-toxin and killing the cell. The constitutive promoter regulating expression of the anti-toxin should be a weaker promoter than the promoter driving expression of the toxin. The araC gene is under the control of a constitutive promoter in this circuit.

FIG. 69C depicts another non-limiting embodiment of the disclosure, wherein the expression of a heterologous gene is activated by an exogenous environmental signal. In the absence of arabinose, the AraC transcription factor adopts a conformation that represses transcription. In the presence of arabinose, the AraC transcription factor undergoes a conformational change that allows it to bind to and activate the araBAD promoter, which induces expression of the Tet repressor (TetR) and an anti-toxin. The anti-toxin builds up in the recombinant bacterial cell, while TetR prevents expression of a toxin (which is under the control of a promoter having a TetR binding site). However, when arabinose is not present, both the anti-toxin and TetR are not expressed. Since TetR is not present to repress expression of the toxin, the toxin is expressed and kills the cell. The araC gene is either under the control of a constitutive promoter or an inducible promoter (e.g., AraC promoter) in this circuit.

Figure 70:
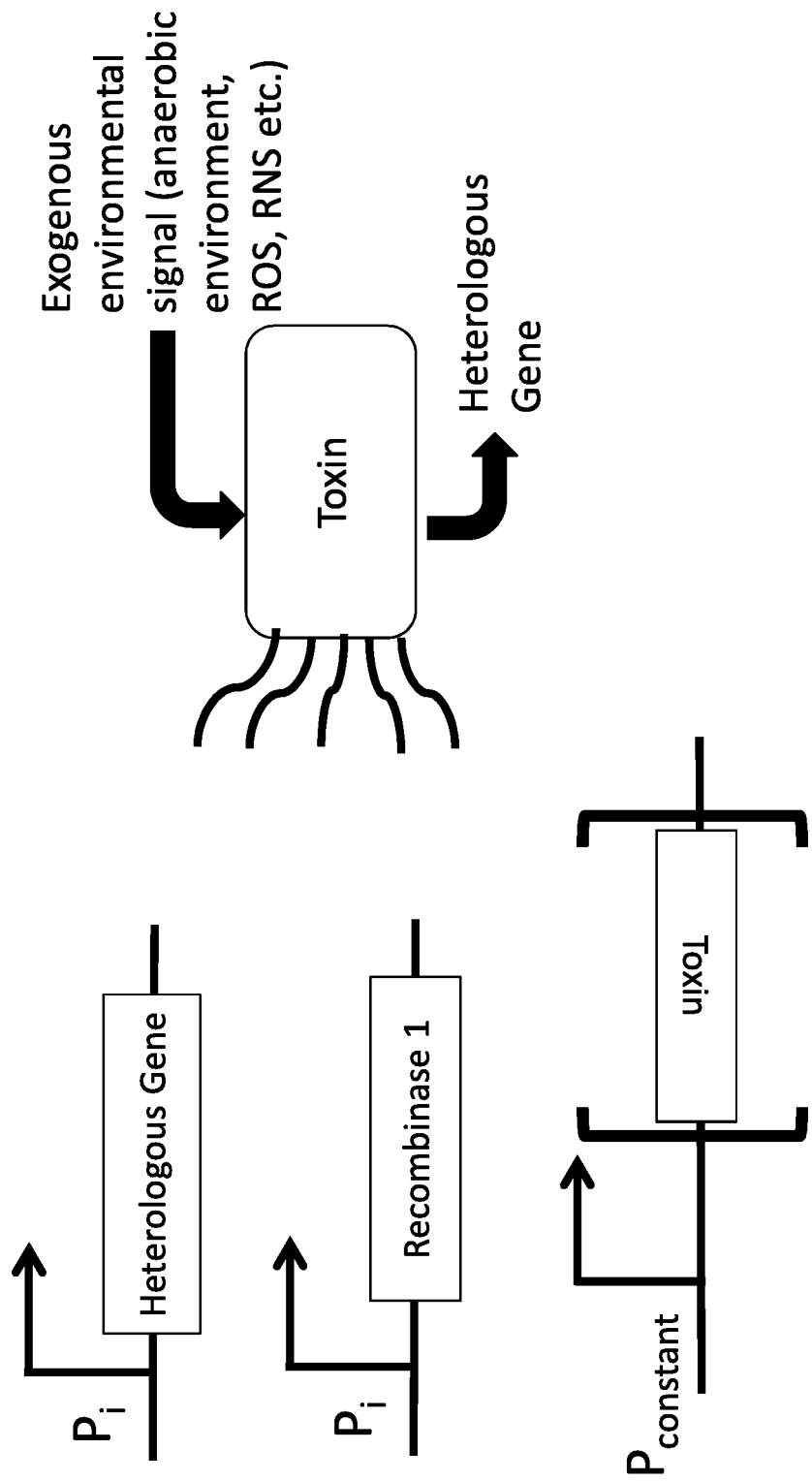

FIG. 70 depicts one non-limiting embodiment of the disclosure, where an exogenous environmental condition or one or more environmental signals activates expression of a heterologous gene and at least one recombinase from an inducible promoter or inducible promoters. The recombinase then flips a toxin gene into an activated conformation, and the natural kinetics of the recombinase create a time delay in expression of the toxin, allowing the heterologous gene to be fully expressed. Once the toxin is expressed, it kills the cell.

Figure 71:
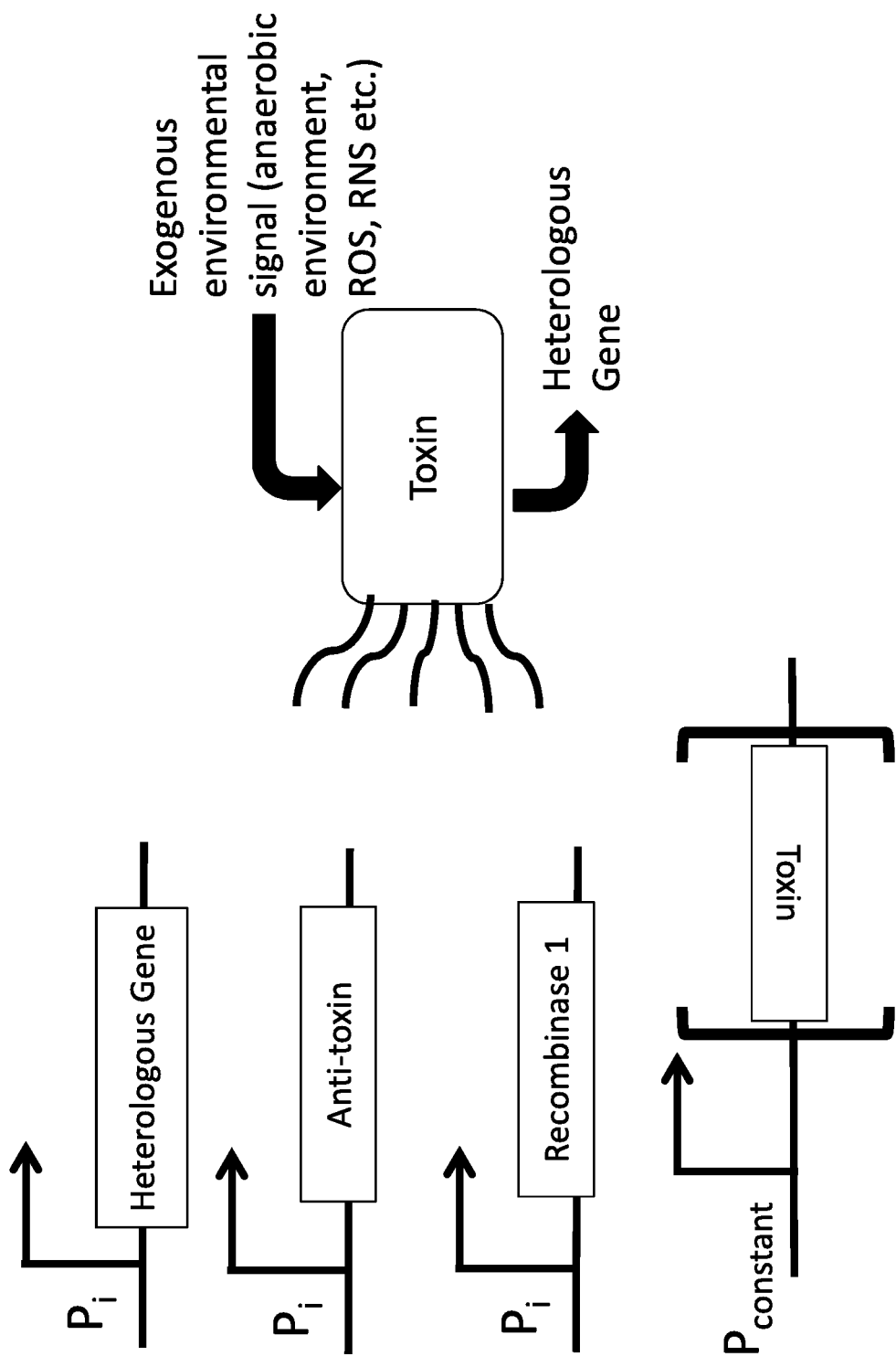

FIG. 71 depicts another non-limiting embodiment of the disclosure, where an exogenous environmental condition or one or more environmental signals activates expression of a heterologous gene, an anti-toxin, and at least one recombinase from an inducible promoter or inducible promoters. The recombinase then flips a toxin gene into an activated conformation, but the presence of the accumulated anti-toxin suppresses the activity of the toxin. Once the exogenous environmental condition or cue(s) is no longer present, expression of the anti-toxin is turned off. The toxin is constitutively expressed, continues to accumulate, and kills the bacterial cell.

Figure 72:
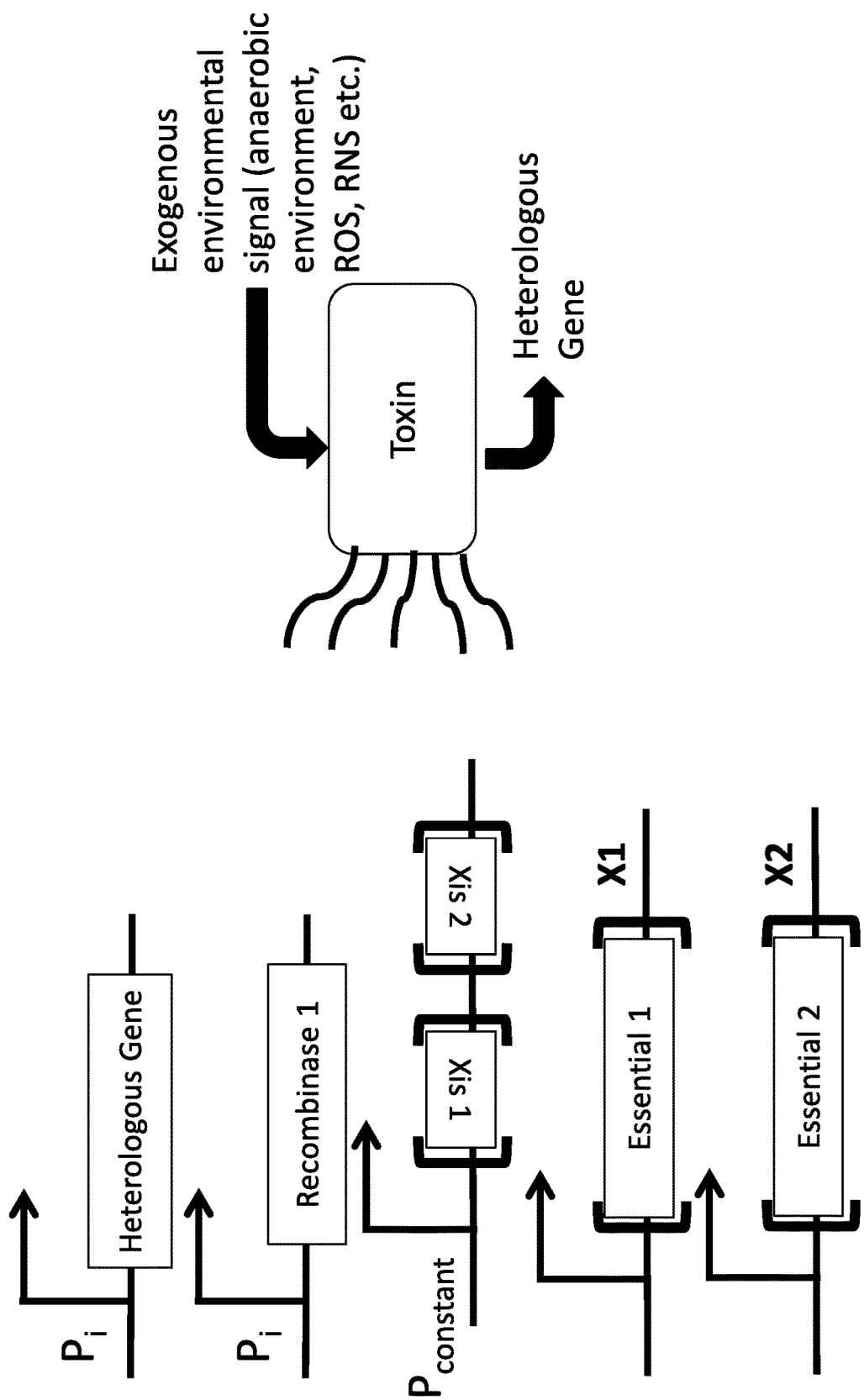

FIG. 72 depicts another non-limiting embodiment of the disclosure, where an exogenous environmental condition or one or more environmental signals activates expression of a heterologous gene and at least one recombinase from an inducible promoter or inducible promoters. The recombinase then flips at least one excision enzyme into an activated conformation. The at least one excision enzyme then excises one or more essential genes, leading to senescence, and eventual cell death. The natural kinetics of the recombinase and excision genes cause a time delay, the kinetics of which can be altered and optimized depending on the number and choice of essential genes to be excised, allowing cell death to occur within a matter of hours or days. The presence of multiple nested recombinases can be used to further control the timing of cell death.

Figure 73:
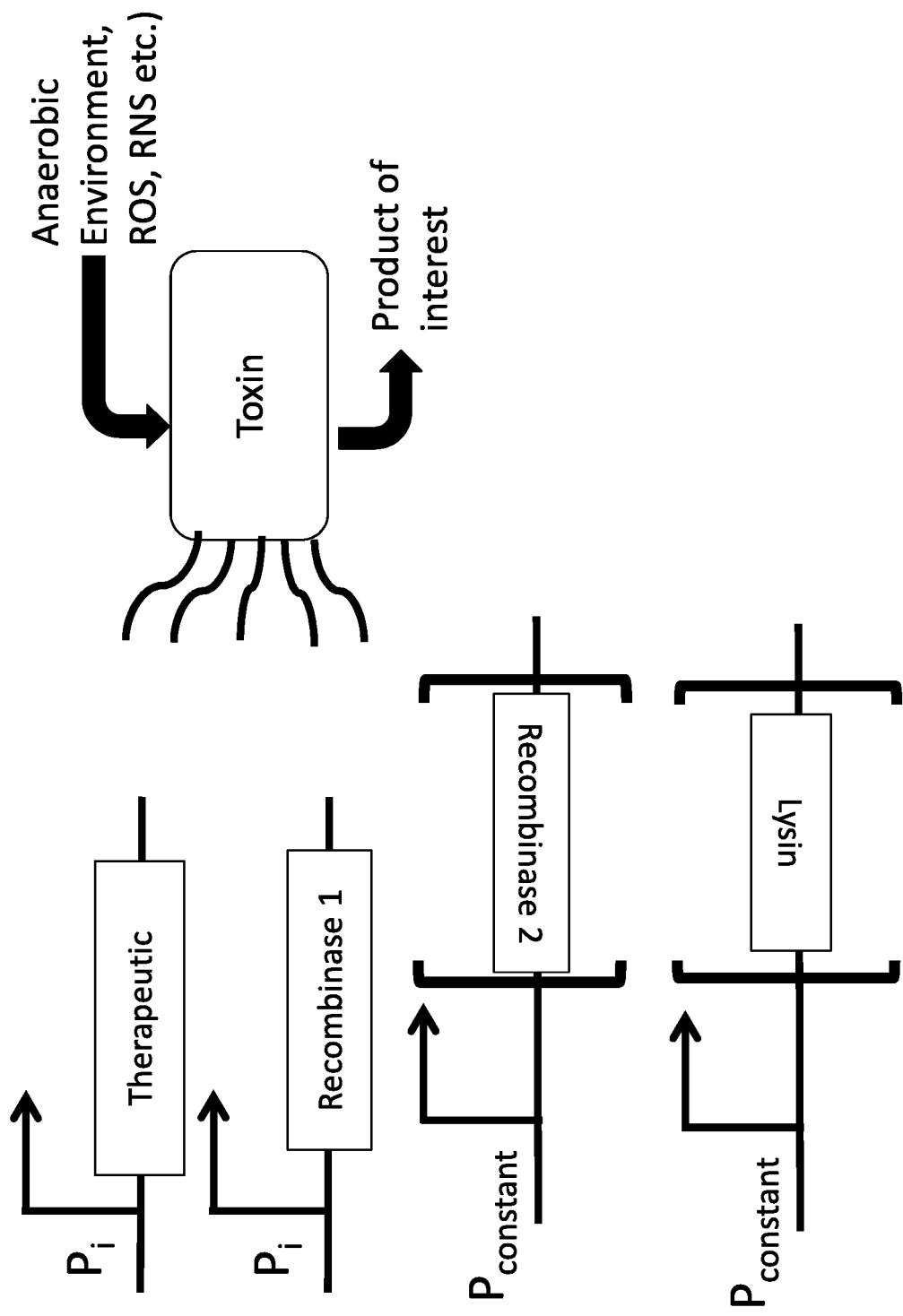

FIG. 73 depicts one non-limiting embodiment of the disclosure, where an exogenous environmental condition or one or more environmental signals activates expression of a heterologous gene and a first recombinase from an inducible promoter or inducible promoters. The recombinase then flips a second recombinase from an inverted orientation to an active conformation. The activated second recombinase flips the toxin gene into an activated conformation, and the natural kinetics of the recombinase create a time delay in expression of the toxin, allowing the heterologous gene to be fully expressed. Once the toxin is expressed, it kills the cell.

Figure 74:
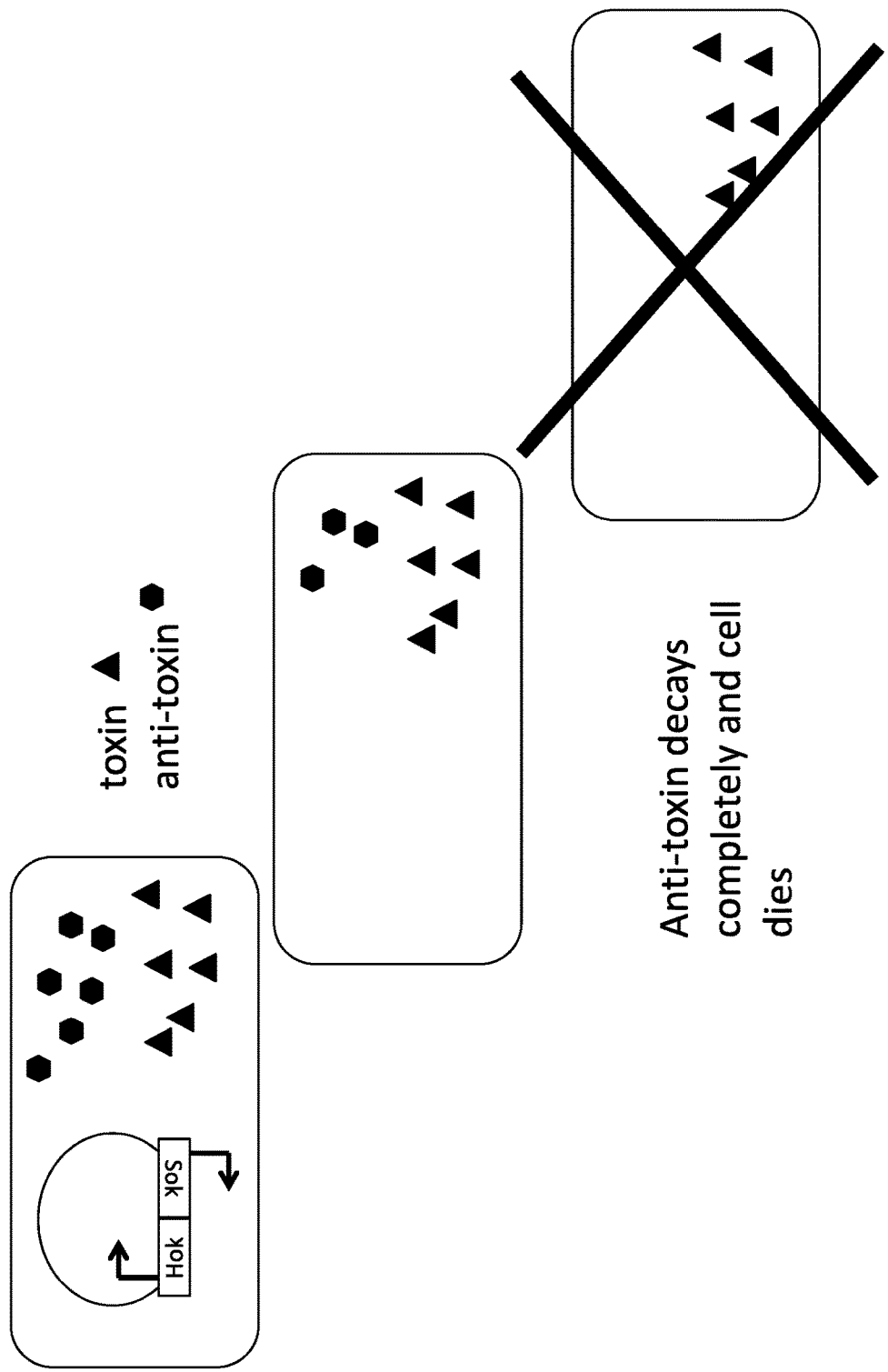

FIG. 74 depicts a one non-limiting embodiment of the disclosure, which comprises a plasmid stability system with a plasmid that produces both a short-lived anti-toxin and a long-lived toxin. When the cell loses the plasmid, the anti-toxin is no longer produced, and the toxin kills the cell. In one embodiment, the genetically engineered bacteria produce an equal amount of a Hok toxin and a short-lived Sok antitoxin. In the upper panel, the cell produces equal amounts of toxin and anti-toxin and is stable. In the center panel, the cell loses the plasmid and anti-toxin begins to decay. In the lower panel, the anti-toxin decays completely, and the cell dies.

Figure 75:
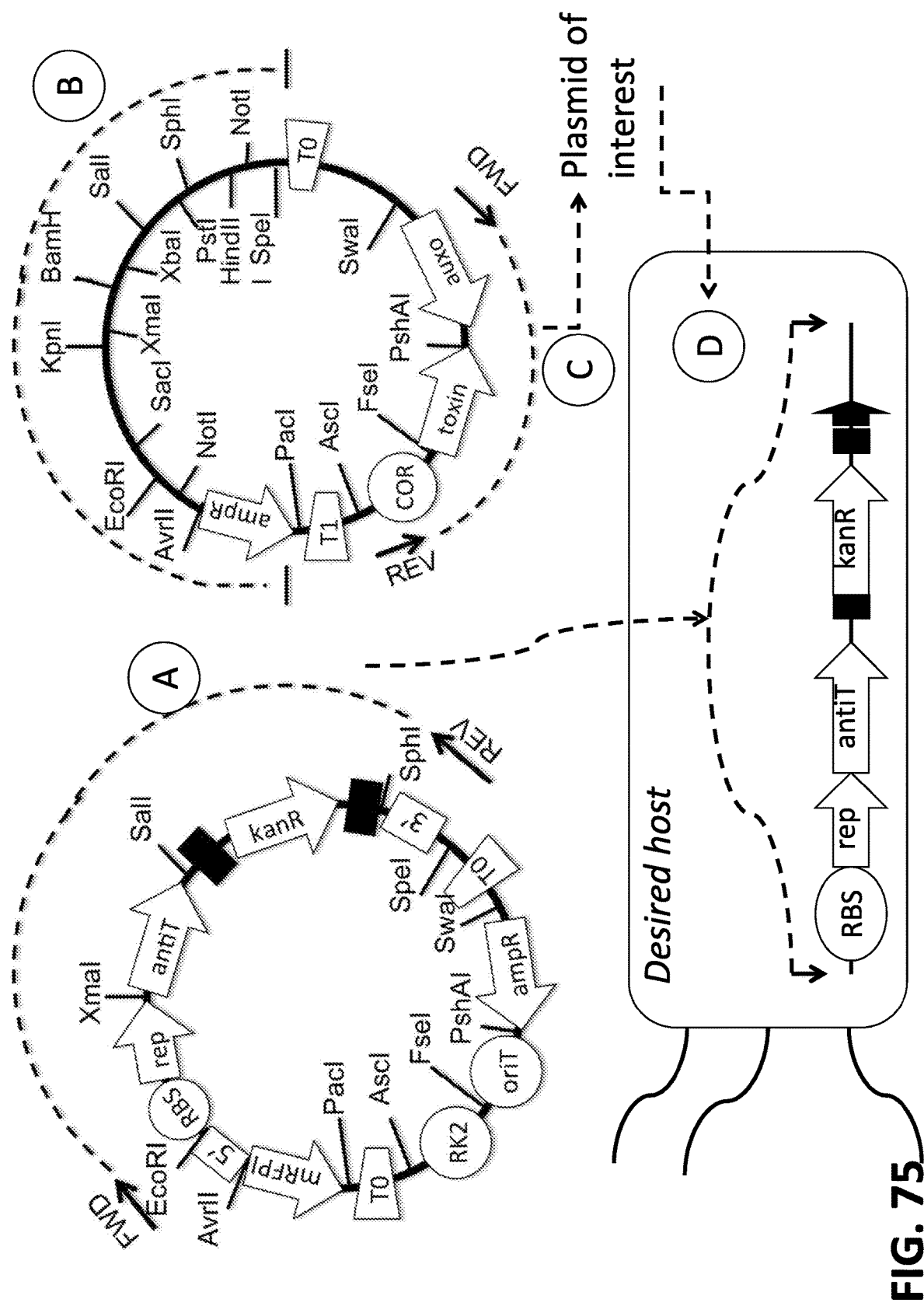

FIG. 75 depicts the use of GeneGuards as an engineered safety component. All engineered DNA is present on a plasmid which can be conditionally destroyed. See, e.g., Wright et al., 2015.

Figure 76A:
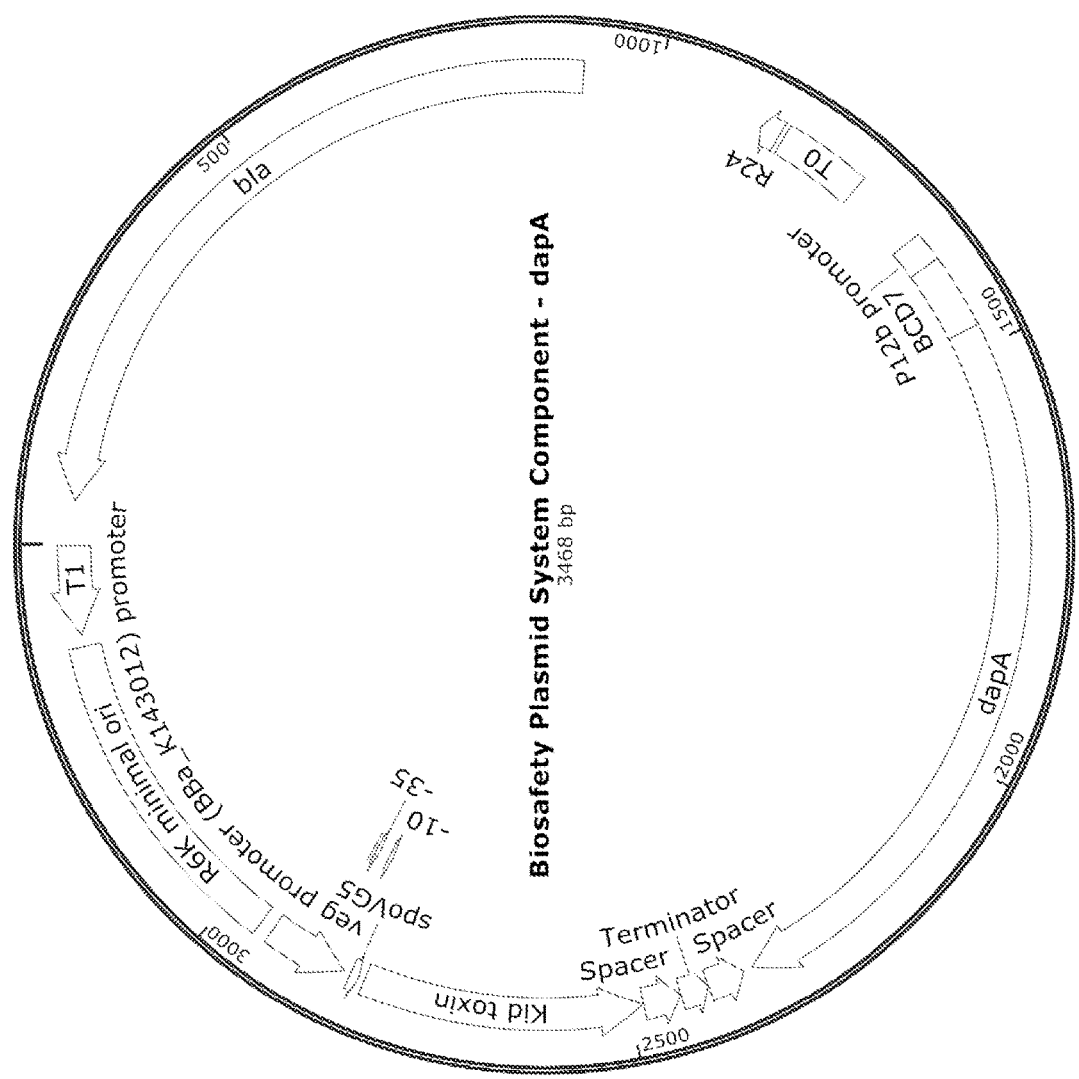
Figure 76B:
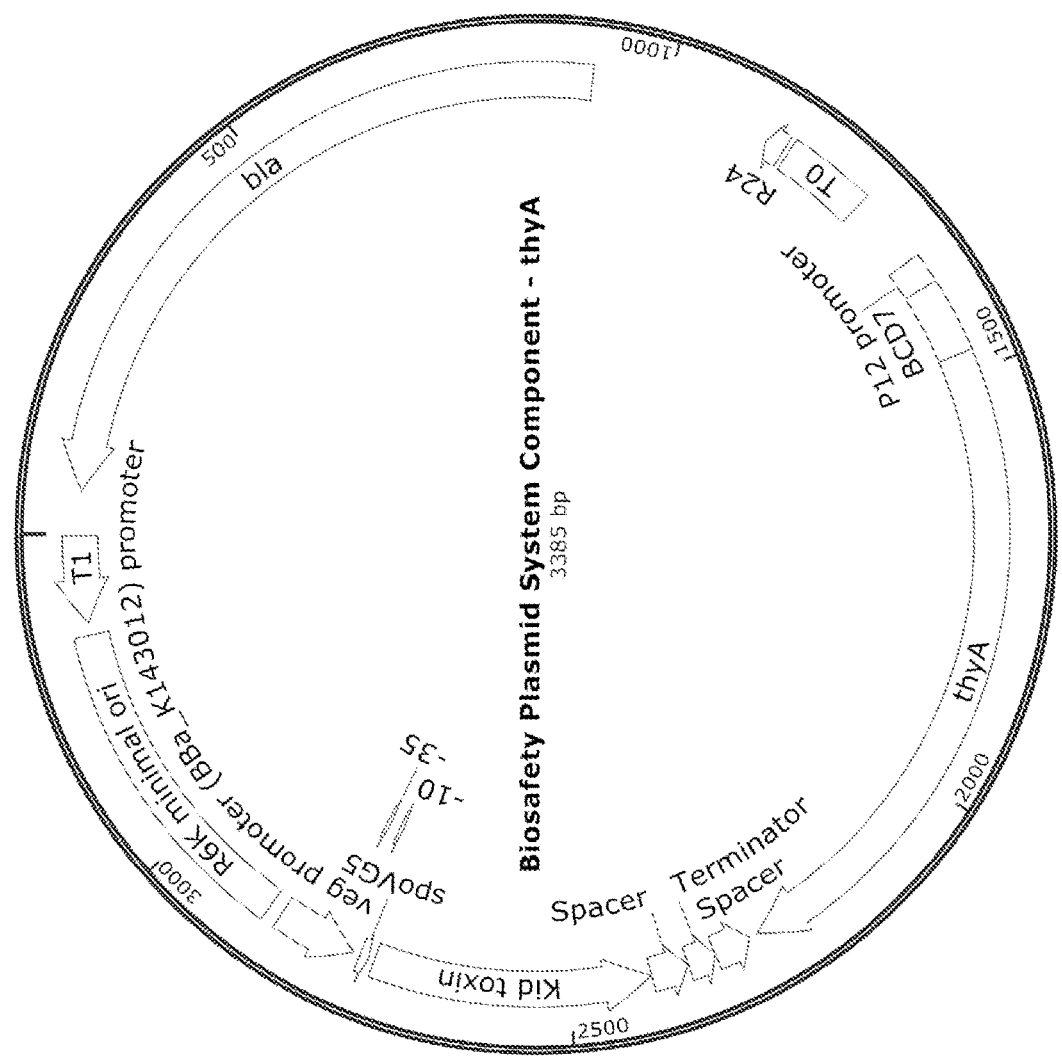
Figure 76C:
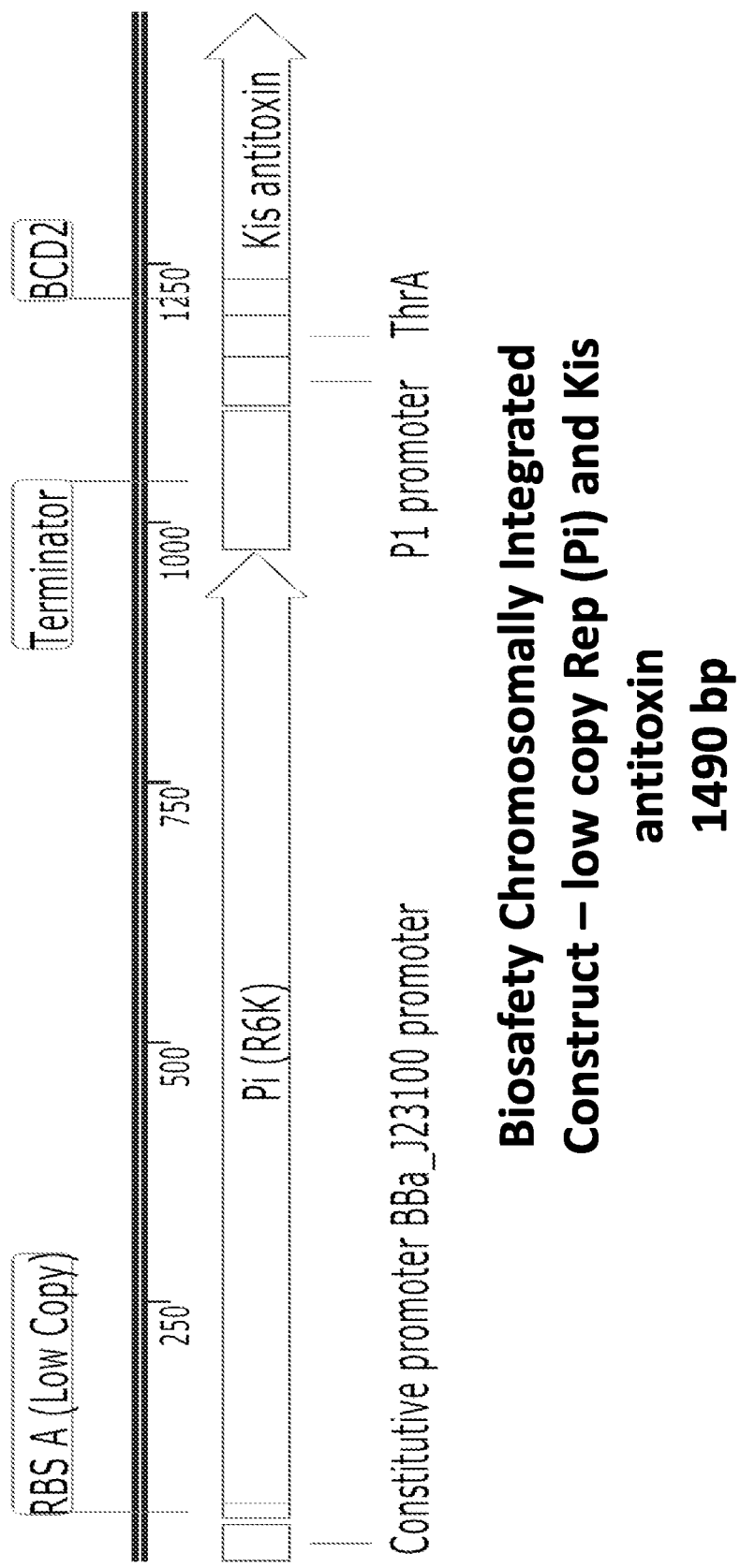
Figure 76D:
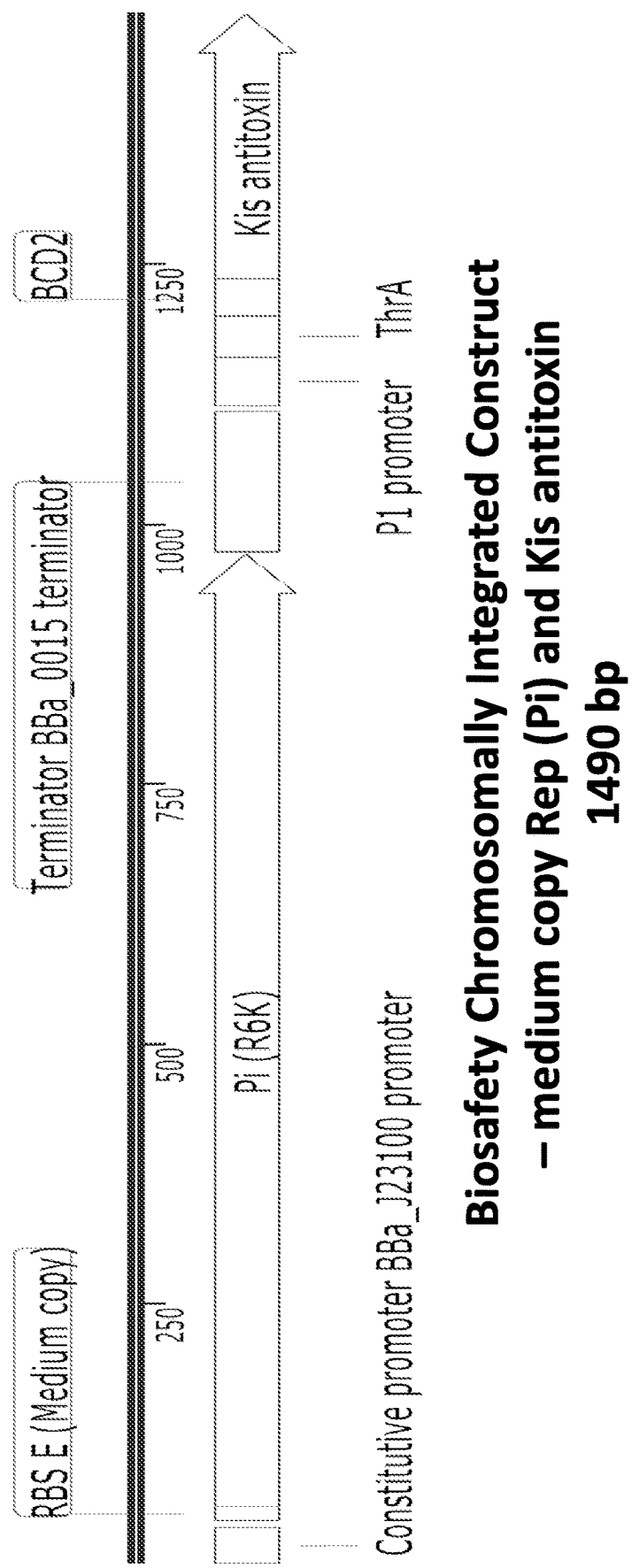

FIGS. 76A-76D depict schematics of non-limiting examples of the gene organization of plasmids, which function as a component of a biosafety system (FIG. 76A and FIG. 76B), which also contains a chromosomal component (shown in FIG. 76C and FIG. 76D). The Biosafety Plasmid System Vector comprises Kid Toxin and R6K minimal ori, dapA (FIG. 76A) and thyA (FIG. 76B) and promoter elements driving expression of these components. In some embodiments, bla is knocked out and replaced with one or more constructs described herein, in which a first protein of interest (POI1) and/or a second protein of interest, e.g., a transporter (POI2), and/or a third protein of interest (POI3) are expressed from an inducible or constitutive promoter. FIG. 76C and FIG. 76D depict schematics of the gene organization of the chromosomal component of a biosafety system. FIG. 76C depicts a construct comprising low copy Rep (Pi) and Kis antitoxin, in which transcription of Pi (Rep), which is required for the replication of the plasmid component of the system, is driven by a low copy RBS containing promoter. FIG. 76D depicts a construct comprising a medium-copy Rep (Pi) and Kis antitoxin, in which transcription of Pi (Rep), which is required for the replication of the plasmid component of the system, is driven by a medium copy RBS containing promoter. If the plasmid containing the functional DapA is used (as shown in FIG. 76A), then the chromosomal constructs shown in FIG. 76C and FIG. 76D are knocked into the DapA locus. If the plasmid containing the functional ThyA is used (as shown in FIG. 76B), then the chromosomal constructs shown in FIG. 76C and FIG. 76D are knocked into the ThyA locus. In this system, the bacteria comprising the chromosomal construct and a knocked out dapA or thyA gene can grow in the absence of dap or thymidine only in the presence of the plasmid.

Figure 77:
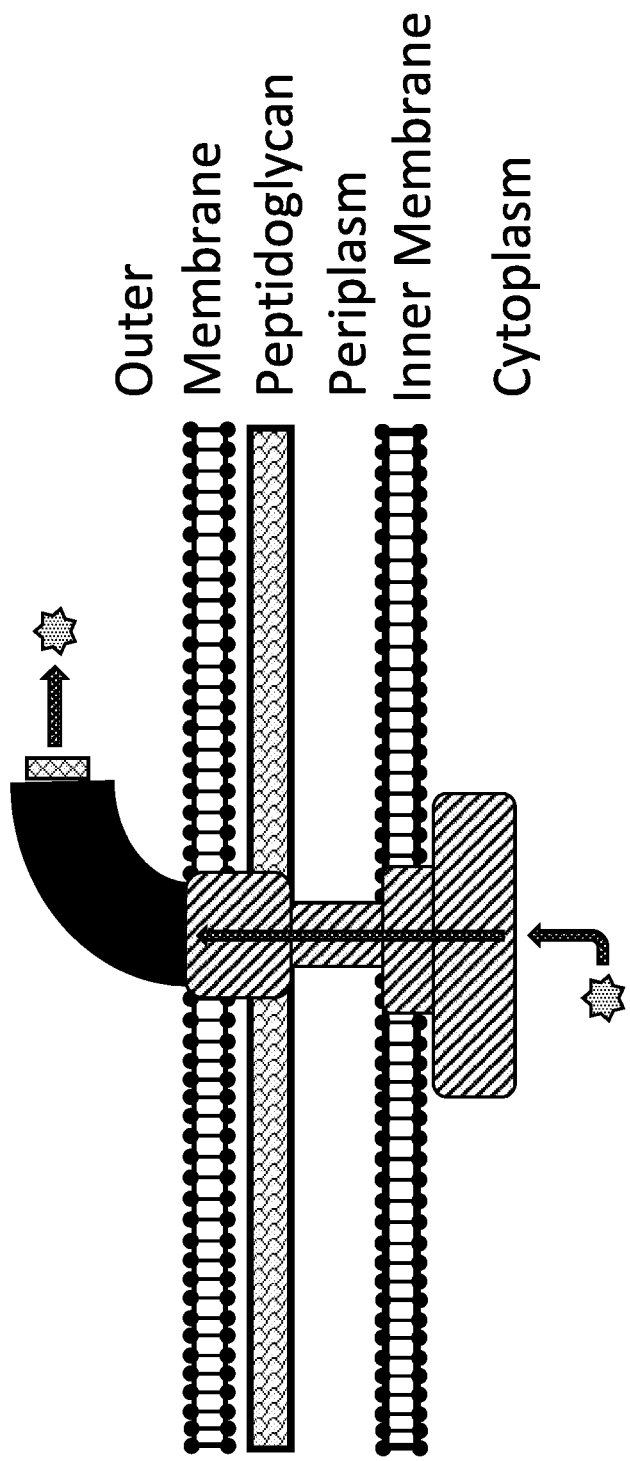

FIG. 77 depicts a schematic of a secretion system based on the flagellar type III secretion in which an incomplete flagellum is used to secrete a therapeutic peptide of interest (star) by recombinantly fusing the peptide to an N-terminal flagellar secretion signal of a native flagellar component so that the intracellularly expressed chimeric peptide can be mobilized across the inner and outer membranes into the surrounding host environment.

Figure 78:
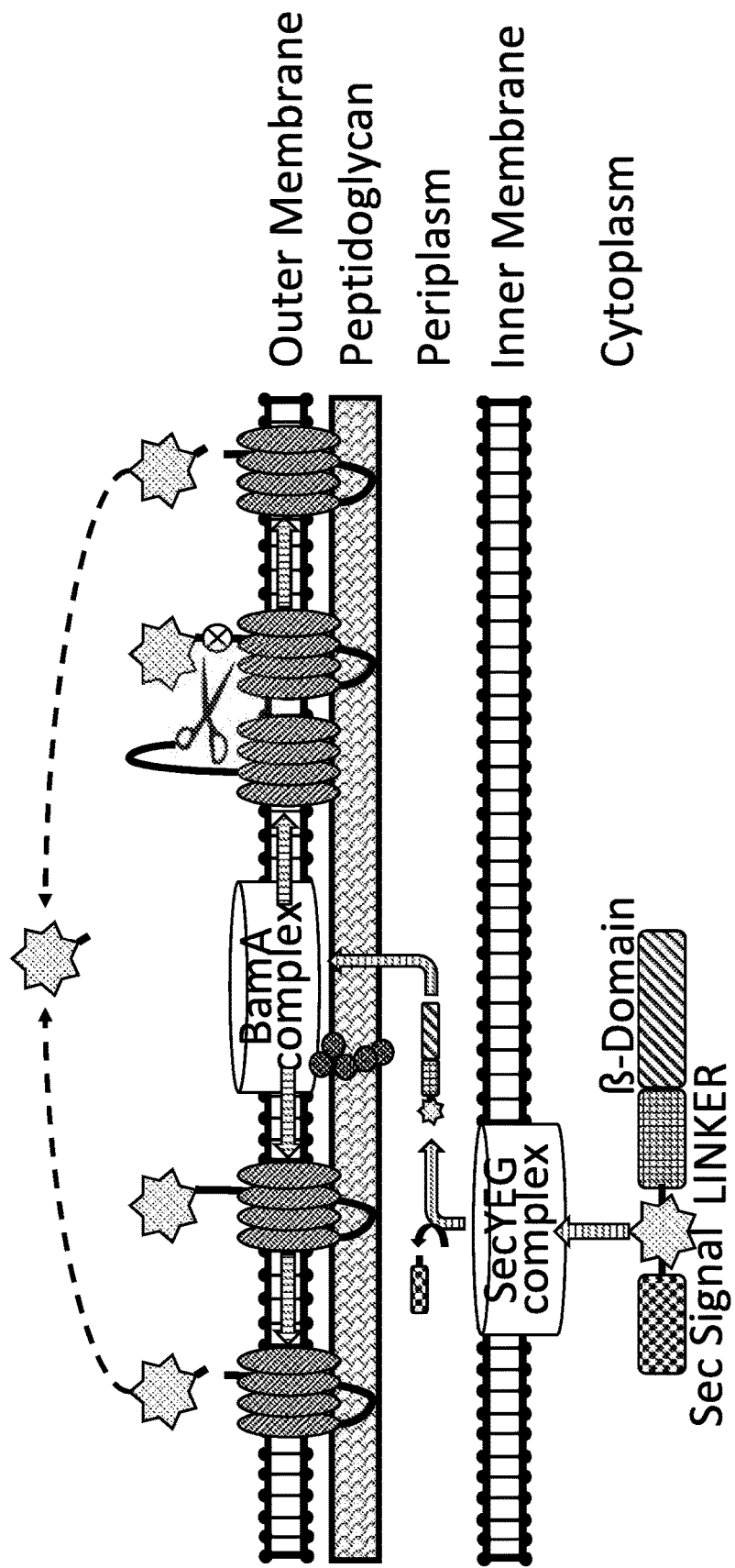

FIG. 78 depicts a schematic of a type V secretion system for the extracellular production of recombinant proteins in which a therapeutic peptide (star) can be fused to an N-terminal secretion signal, a linker and the beta-domain of an autotransporter. In this system, the N-terminal signal sequence directs the protein to the SecA-YEG machinery which moves the protein across the inner membrane into the periplasm, followed by subsequent cleavage of the signal sequence. The beta-domain is recruited to the Bam complex where the beta-domain is folded and inserted into the outer membrane as a beta-barrel structure. The therapeutic peptide is then thread through the hollow pore of the beta-barrel structure ahead of the linker sequence. The therapeutic peptide is freed from the linker system by an autocatalytic cleavage or by targeting of a membrane-associated peptidase (scissors) to a complementary protease cut site in the linker.

Figure 79:
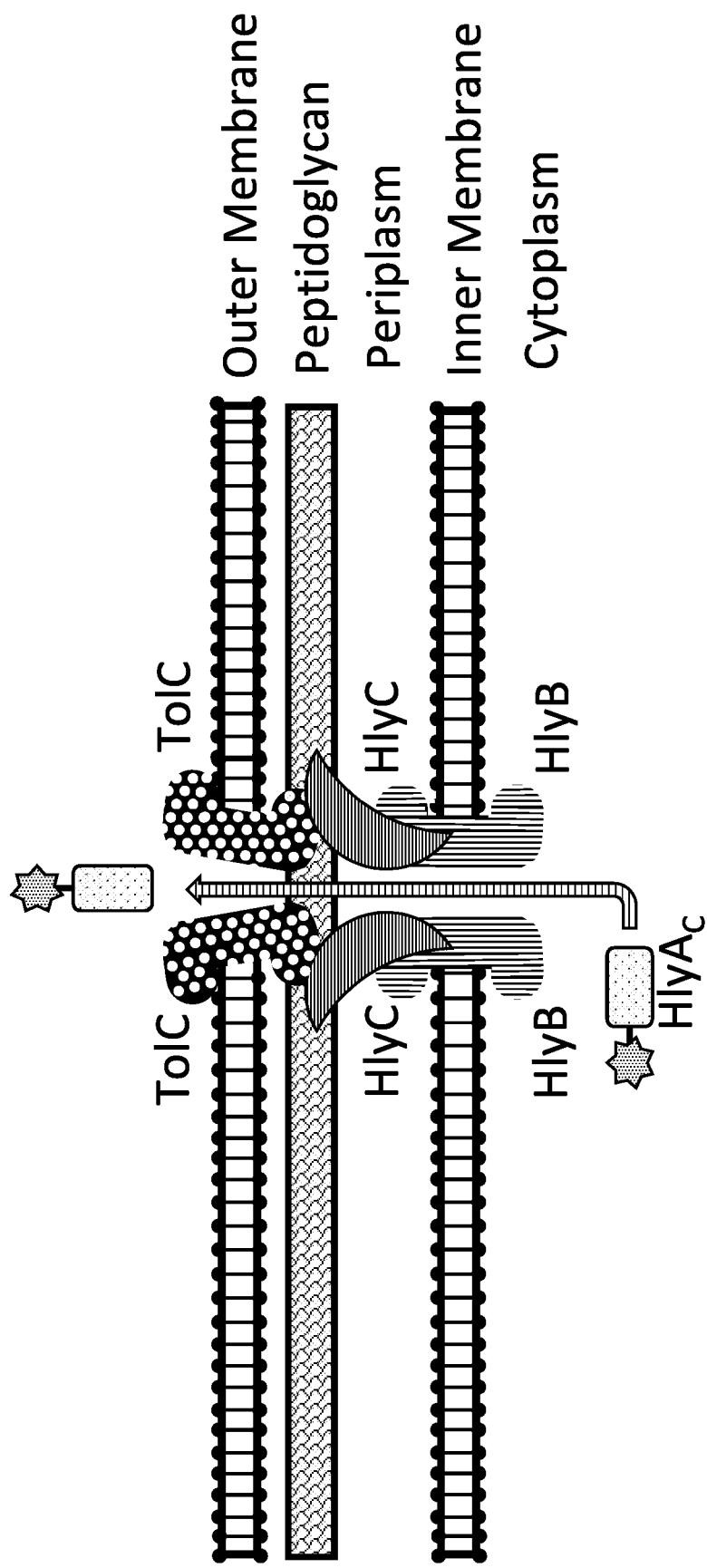

FIG. 79 depicts a schematic of a type I secretion system, which translocates a passenger peptide directly from the cytoplasm to the extracellular space using HlyB (an ATP-binding cassette transporter); HlyD (a membrane fusion protein); and TolC (an outer membrane protein) which form a channel through both the inner and outer membranes. The secretion signal-containing C-terminal portion of HlyA is fused to the C-terminal portion of a therapeutic peptide (star) to mediate secretion of this peptide.

Figure 80:
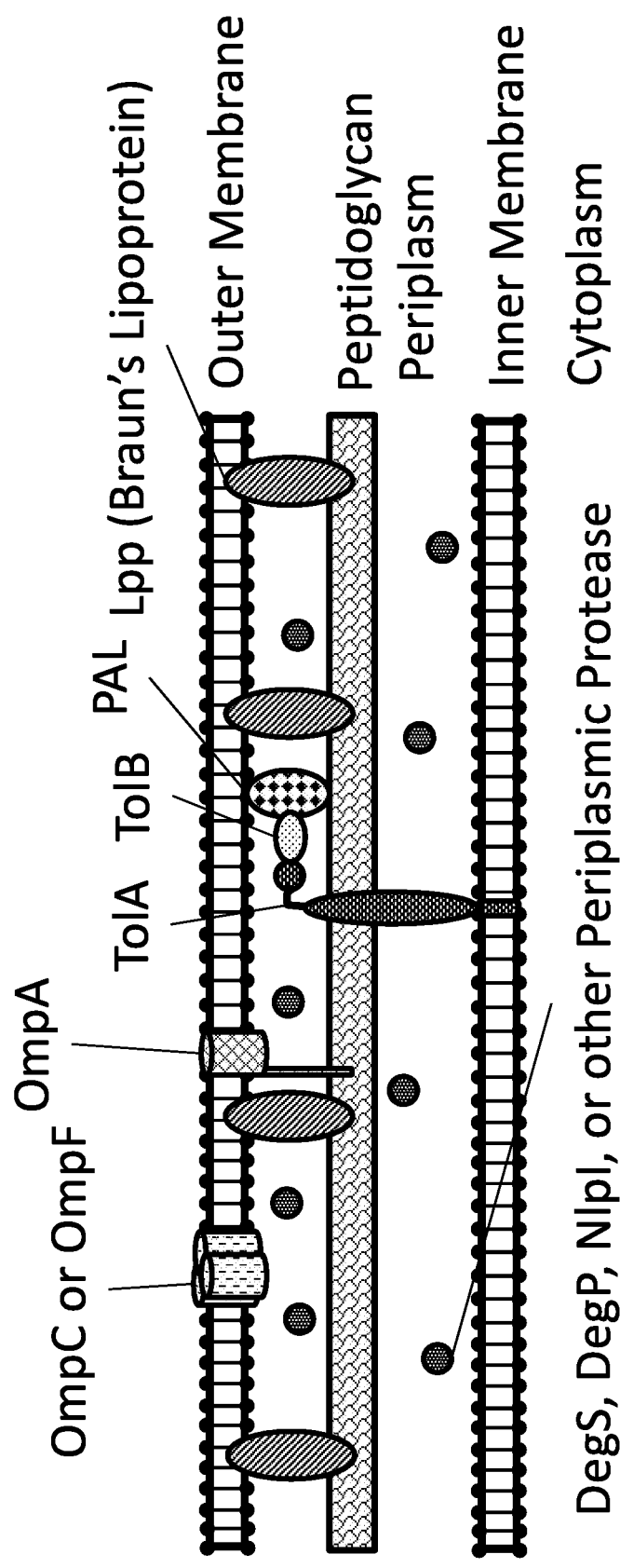

FIG. 80 depicts a schematic of the outer and inner membranes of a gram-negative bacterium, and several deletion targets for generating a leaky or destabilized outer membrane, thereby facilitating the translocation of a therapeutic polypeptides to the extracellular space, e.g., therapeutic polypeptides of eukaryotic origin containing disulphide bonds. Deactivating mutations of one or more genes encoding a protein that tethers the outer membrane to the peptidoglycan skeleton, e.g., lpp, ompC, ompA, ompF, tolA, tolB, pal, and/or one or more genes encoding a periplasmic protease, e.g., degS, degP, nlpI, generates a leaky phenotype. Combinations of mutations may synergistically enhance the leaky phenotype.

Figure 81:
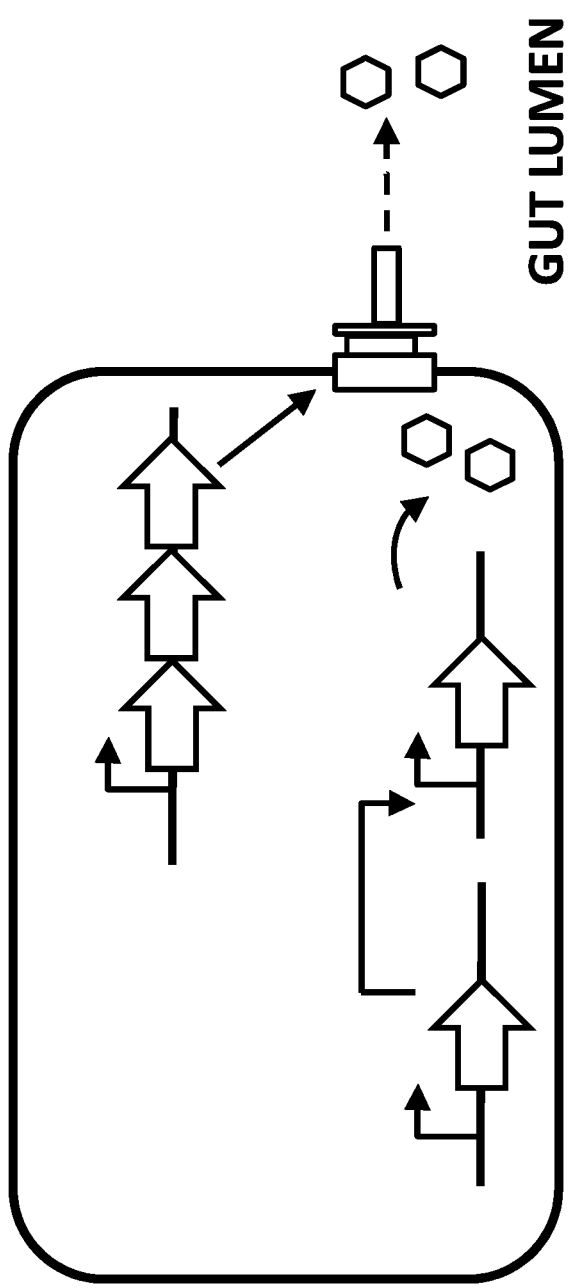

FIG. 81 depicts a modified type 3 secretion system (T3SS) to allow the bacteria to inject secreted therapeutic proteins into the gut lumen. An inducible promoter (small arrow, top), e.g. a FNR-inducible promoter, drives expression of the T3 secretion system gene cassette (3 large arrows, top) that produces the apparatus that secretes tagged peptides out of the cell. An inducible promoter (small arrow, bottom), e.g. a FNR-inducible promoter, drives expression of a regulatory factor, e.g. T7 polymerase, that then activates the expression of the tagged therapeutic peptide (hexagons).

Figure 82:
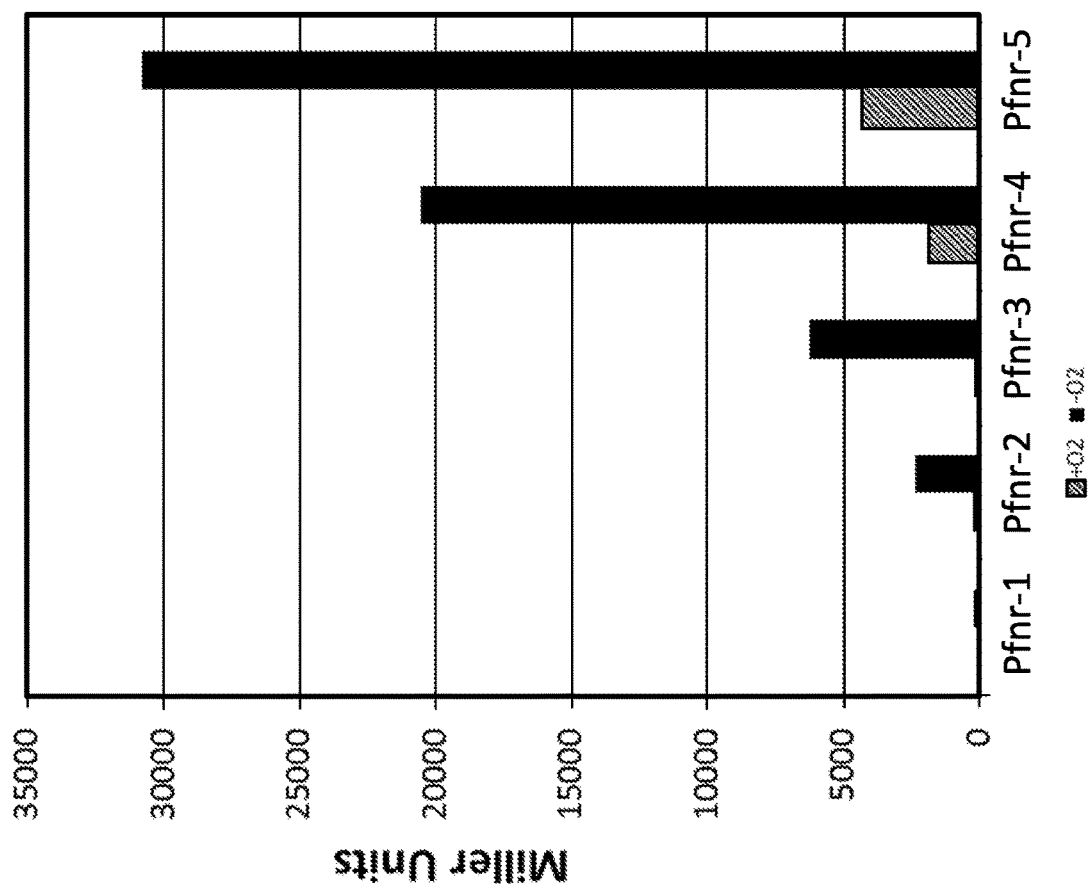

FIG. 82 depicts β-galactosidase levels in samples comprising bacteria harboring a low-copy plasmid expressing lacZ from an FNR-responsive promoter selected from the exemplary FNR promoters and sequences described herein. Different FNR-responsive promoters were used to create a library of anaerobic/low oxygen conditions inducible reporters with a variety of expression levels and dynamic ranges. These promoters included strong ribosome binding sites. Bacterial cultures were grown in either aerobic ($+O_2$) or anaerobic conditions ($-O_2$). Samples were removed at 4 hrs and the promoter activity based on β-galactosidase levels was analyzed by performing standard β-galactosidase colorimetric assays.

Figure 83A:
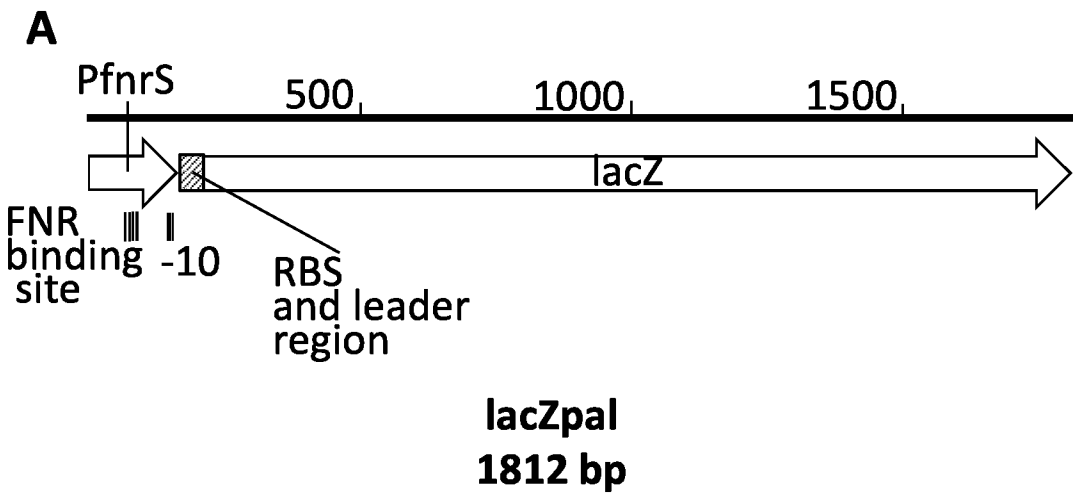
Figure 83B:
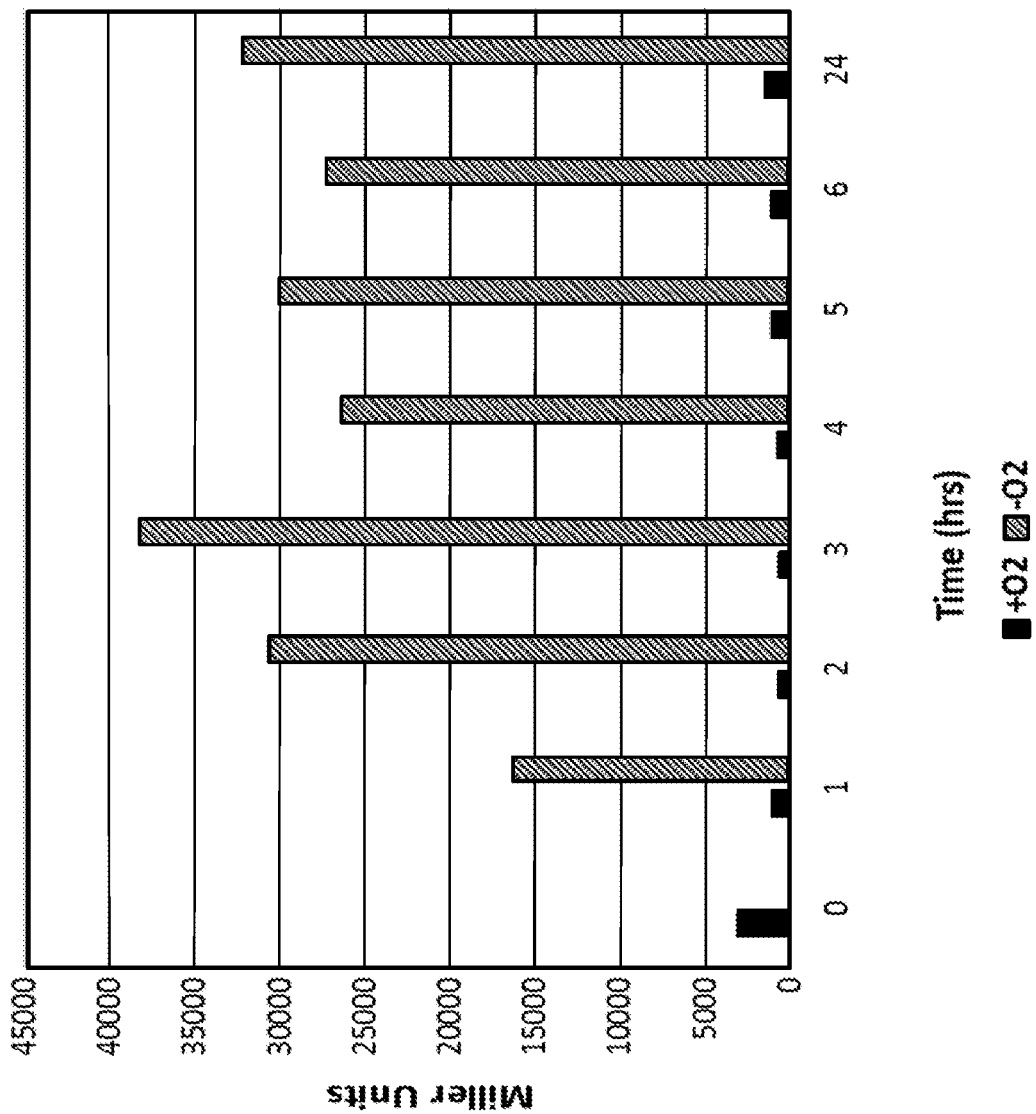
Figure 83C:
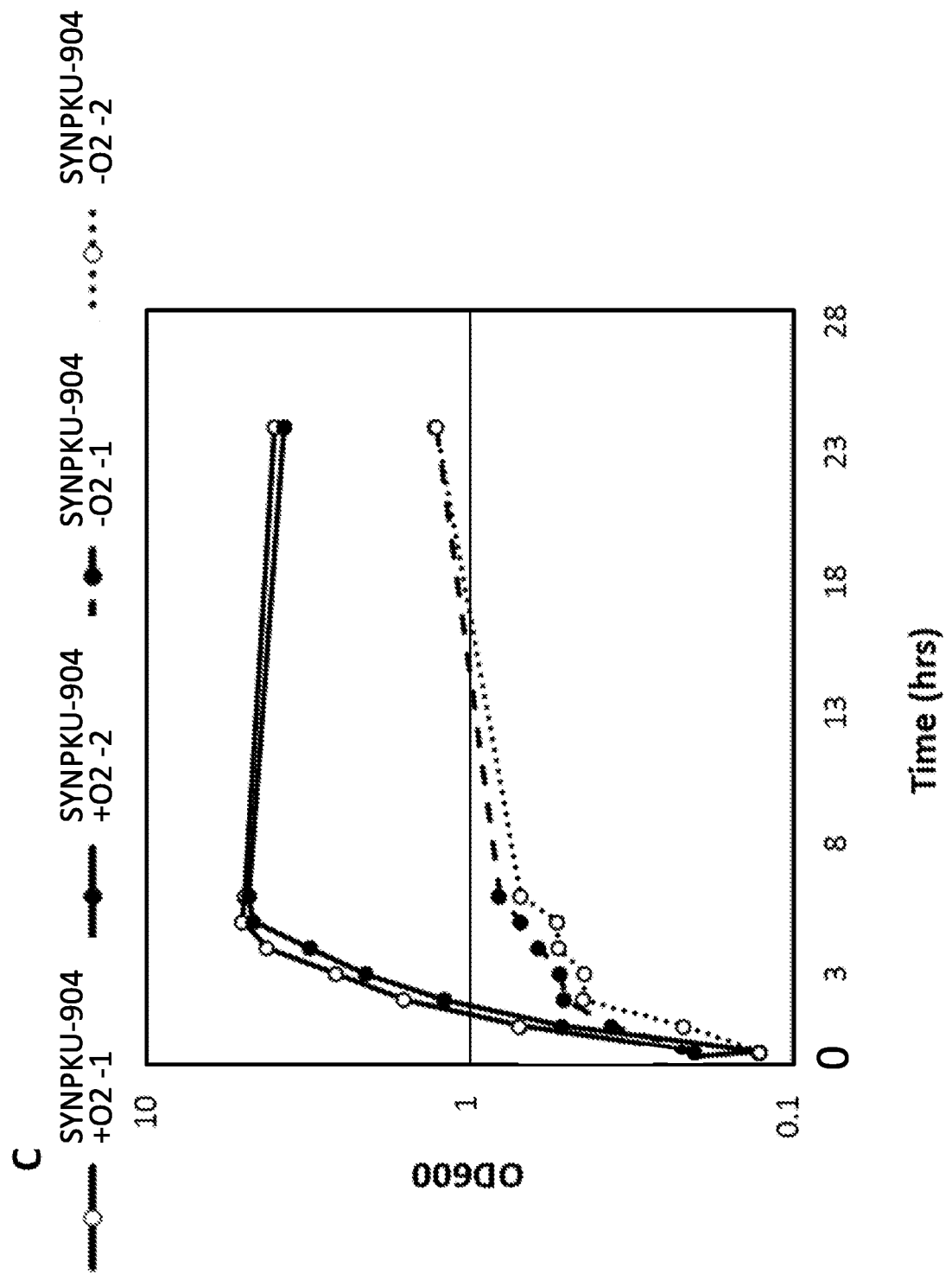

FIG. 83A depicts a schematic representation of the lacZ gene under the control of an exemplary FNR promoter ($P_{fnrs}$). LacZ encodes the β-galactosidase enzyme and is a common reporter gene in bacteria. FIG. 83B depicts FNR promoter activity as a function of β-galactosidase activity in SYN-PKU904. SYN-PKU904, an engineered bacterial strain harboring a low-copy fnrS-lacZ fusion gene, was grown in the presence or absence of oxygen. Values for standard β-galactosidase colorimetric assays are expressed in Miller units (Miller, 1972). These data suggest that the fnrS promoter begins to drive high-level gene expression within 1 hr. under anaerobic and/or low oxygen conditions. FIG. 83C depicts the growth of bacterial cell cultures expressing lacZ over time, both in the presence and absence of oxygen.

Figure 84:
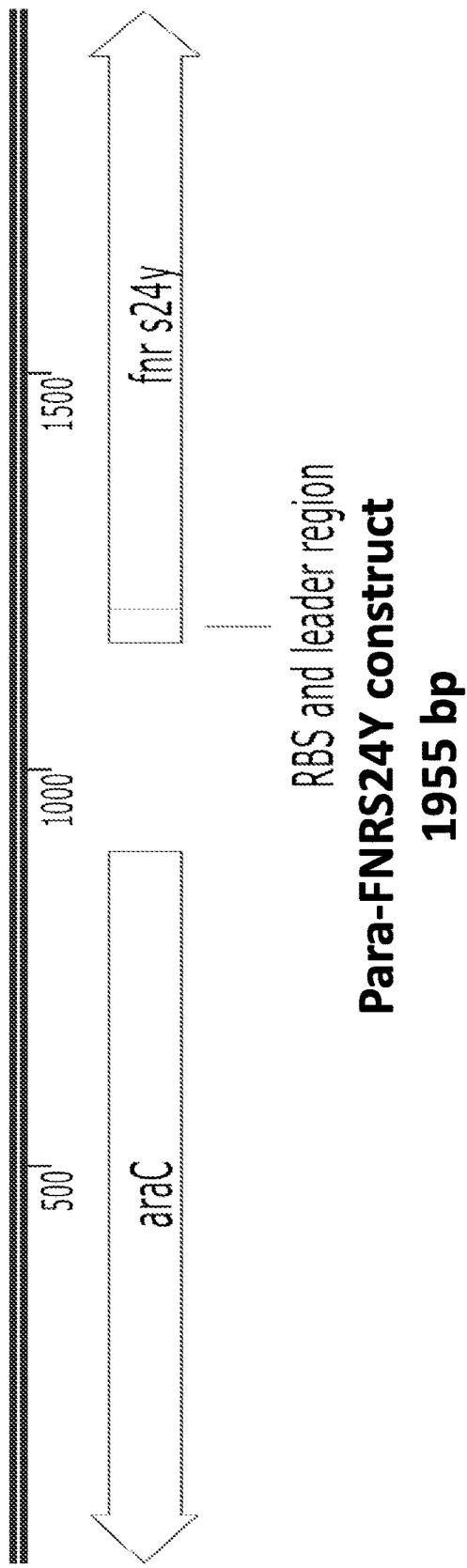

FIG. 84 depicts the gene organization of exemplary construct comprising FNRS24Y driven by the arabinose inducible promoter and araC in reverse direction.

FIG. 85A depicts a "Oxygen bypass switch" useful for aerobic pre-induction of a strain comprising one or proteins of interest (POI), e.g., one or more anti-cancer molecules or immune modulatory effectors (POI1) and a second set of one or more proteins of interest (POI2), e.g., one or more transporter(s)/importer(s) and/or exporter(s), under the control of a low oxygen FNR promoter in vitro in a culture vessel (e.g., flask, fermenter or other vessel, e.g., used during with cell growth, cell expansion, fermentation, recovery, purification, formulation, and/or manufacture). In some embodiments, it is desirable to pre-load a strain with active effector molecules prior to administration. This can be done by pre-inducing the expression of these effectors as the strains are propagated, (e.g., in flasks, fermenters or other appropriate vesicles) and are prepared for in vivo administration. In some embodiments, strains are induced under anaerobic and/or low oxygen conditions, e.g. to induce FNR promoter activity and drive expression of one or more effectors or proteins of interest. In some embodiments, it is desirable to prepare, pre-load and pre-induce the strains under aerobic or microaerobic conditions with one or more effectors or proteins of interest. This allows more efficient growth and, in some cases, reduces the build-up of toxic metabolites.

FNRS24Y is a mutated form of FNR which is more resistant to inactivation by oxygen, and therefore can activate FNR promoters under aerobic conditions (see e.g., Jervis A J, The O2 sensitivity of the transcription factor FNR is controlled by Ser24 modulating the kinetics of [4Fe-4S] to [2Fe-2S] conversion, Proc Natl Acad Sci USA. 2009 Mar. 24; 106(12):4659-64, the contents of which is herein incorporated by reference in its entirety). The O2 sensitivity of the transcription factor FNR is controlled by Ser24 modulating the kinetics of [4Fe-4S] to [2Fe-2S] conversion, Proc Natl Acad Sci USA. 2009 Mar. 24; 106(12):4659-64, the contents of which is herein incorporated by reference in its entirety). In this oxygen bypass system, FNRS24Y is induced by addition of arabinose and then drives the expression of one or more POIs by binding and activating the FNR promoter under aerobic conditions. Thus, strains can be grown, produced or manufactured efficiently under aerobic conditions, while being effectively pre-induced and pre-loaded, as the system takes advantage of the strong FNR promoter resulting in of high levels of expression of one or more POIs. This system does not interfere with or compromise in vivo activation, since the mutated FNRS24Y is no longer expressed in the absence of arabinose, and wild type FNR then binds to the FNR promoter and drives expression of the POIs in vivo. In some embodiments, a LacI promoter and IPTG induction are used in this system (in lieu of Para and arabinose induction). In some embodiments, a rhamnose inducible promoter is used in this system. In some embodiments, a temperature sensitive promoter is used to drive expression of FNRS24Y.

Figure 85B:
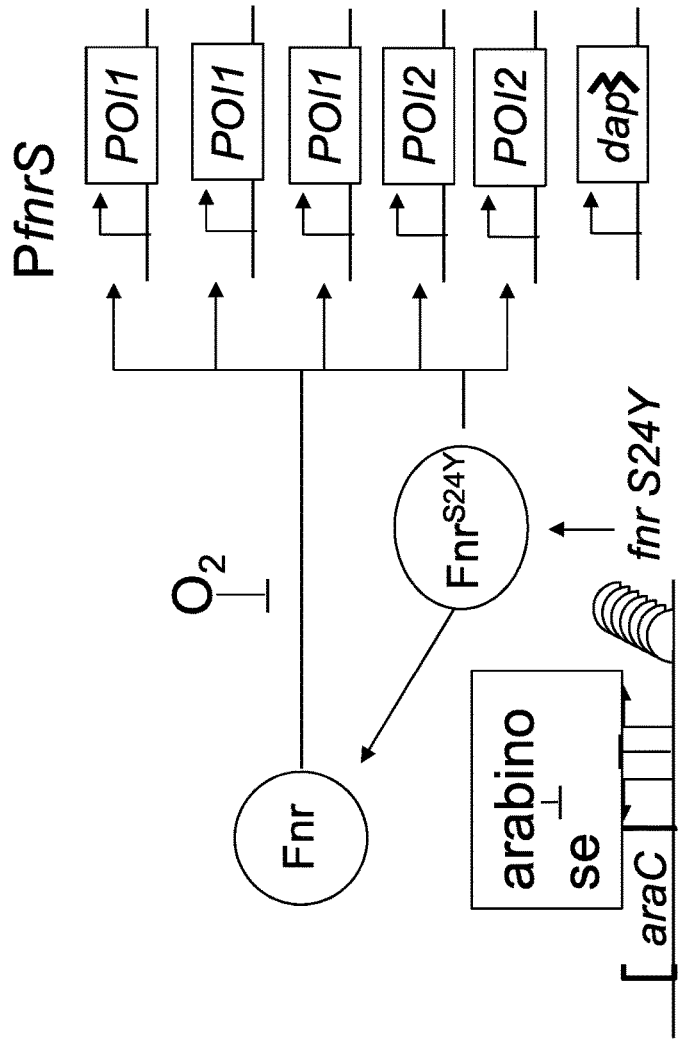

FIG. 85B depicts a strategy to allow the expression of one or more POI(s) under aerobic conditions through the arabinose inducible expression of FNRS24Y. By using a ribosome binding site optimization strategy, the levels of $Fnr^{S24Y}$ expression can be fine-tuned, e.g., under optimal inducing conditions (adequate amounts of arabinose for full induction). Fine-tuning is accomplished by selection of an appropriate RBS with the appropriate translation initiation rate. Bioinformatics tools for optimization of RBS are known in the art.

Figure 85C:
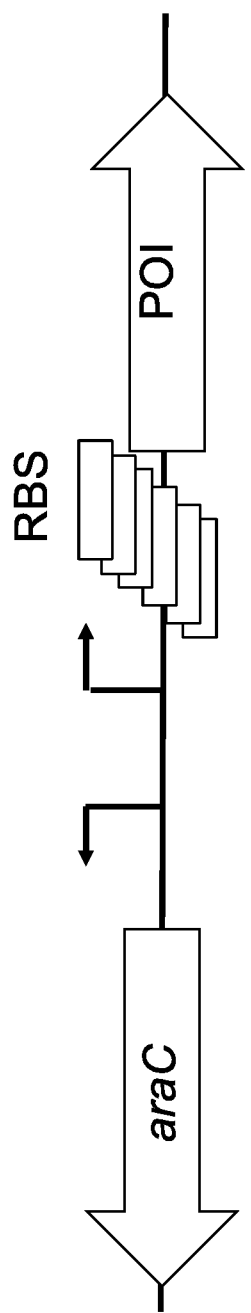

FIG. 85C depicts a strategy to fine-tune the expression of a Para-POI construct by using a ribosome binding site optimization strategy. Bioinformatics tools for optimization of RBS are known in the art. In one strategy, arabinose controlled POI genes can be integrated into the chromosome to provide for efficient aerobic growth and pre-induction of the strain (e.g., in flasks, fermenters or other appropriate vesicles), while integrated versions of $P_{fnrs}$-POI constructs are maintained to allow for strong in vivo induction.

Figure 86:
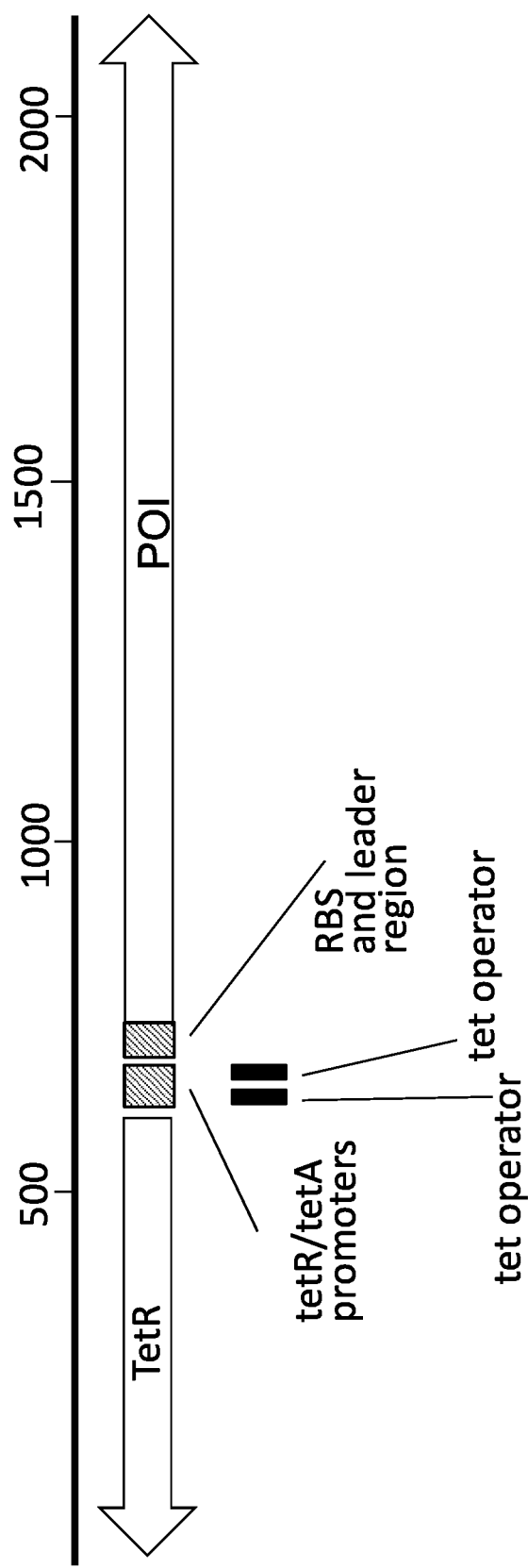

FIG. 86 depicts the gene organization of an exemplary construct, e.g., comprised in SYN-PKU401, comprising a cloned POI gene under the control of a Tet promoter sequence and a Tet repressor gene.

Figure 87:
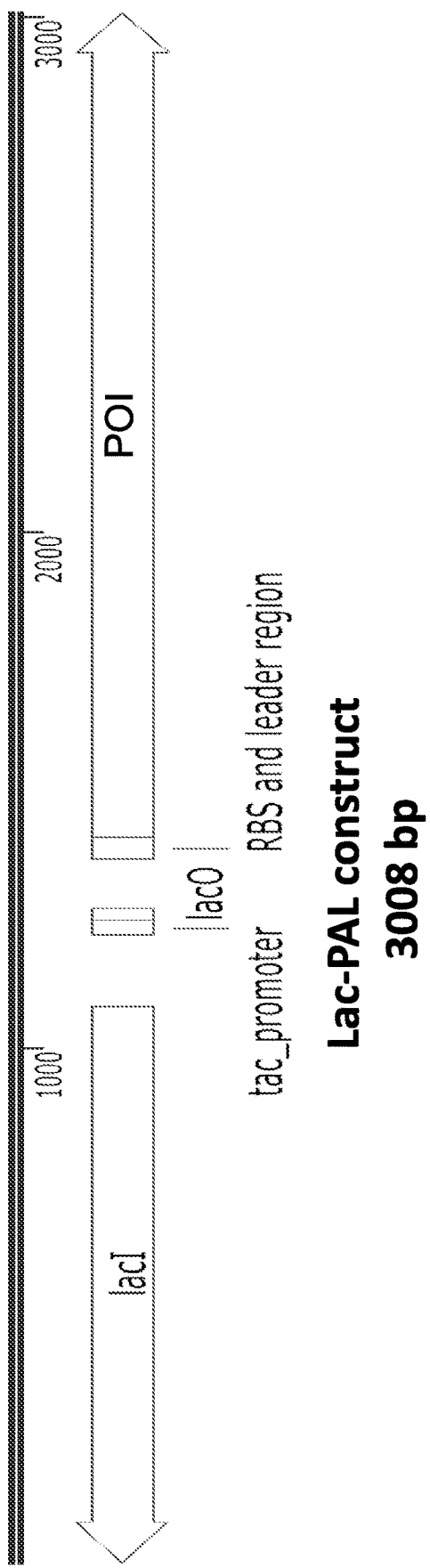

FIG. 87 depicts the gene organization of an exemplary construct comprising LacI in reverse orientation, and a IPTG inducible promoter driving the expression of one or more POIs. In some embodiments, this construct is useful for pre-induction and pre-loading of a therapeutic strain prior to in vivo administration under aerobic conditions and in the presence of inducer, e.g., IPTG. In some embodiments, this construct is used alone. In some embodiments, the construct is used in combination with other constitutive or inducible POI constructs, e.g., low oxygen, arabinose or IPTG inducible constructs. In some embodiments, the construct is used in combination with a low-oxygen inducible construct which is active in an in vivo setting.

In some embodiments, the construct is located on a plasmid, e.g., a low copy or a high copy plasmid. In some embodiments, the construct is located on a plasmid component of a biosafety system. In some embodiments, the construct is integrated into the bacterial chromosome at one or more locations. In some embodiments, the construct is used in combination with construct expressing a second POI, e.g., a transporter, which can either be provided on a plasmid or is integrated into the bacterial chromosome at one or more locations. POI2 expression may be constitutive or driven by an inducible promoter, e.g., low-oxygen, arabinose, or IPTG. In some embodiments, the construct is located on a plasmid, e.g., a low or high copy plasmid. In some embodiments, the construct is employed in a biosafety system, such as the system shown in FIG. 76A, FIG. 76B, FIG. 76C, and FIG. 76D. In some embodiments, the construct is integrated into the genome at one or more locations described herein.

Figure 88A:
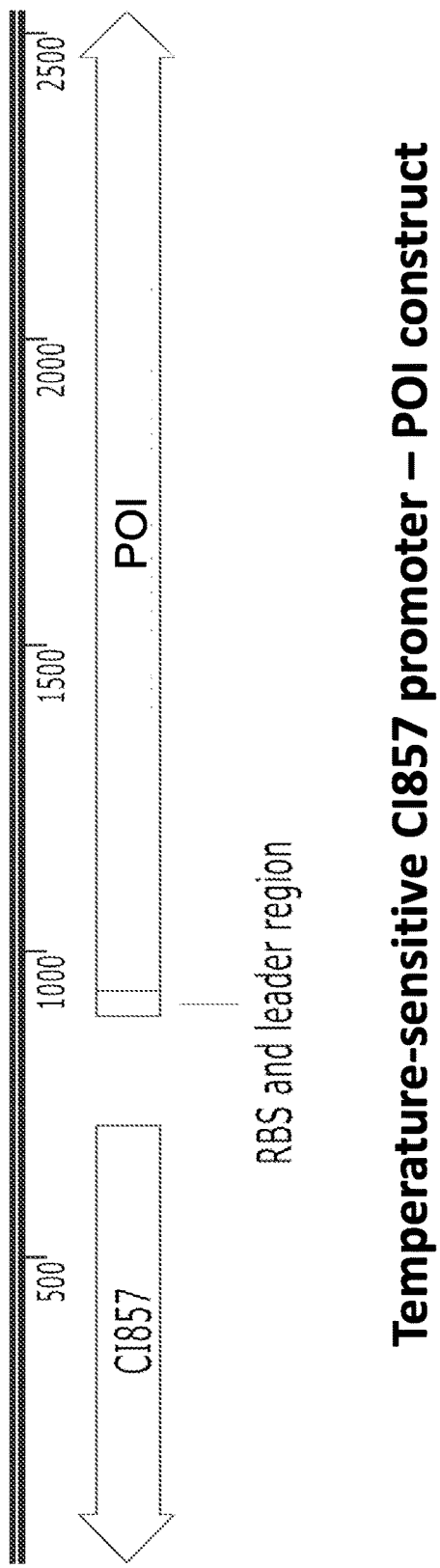
Figure 88B:
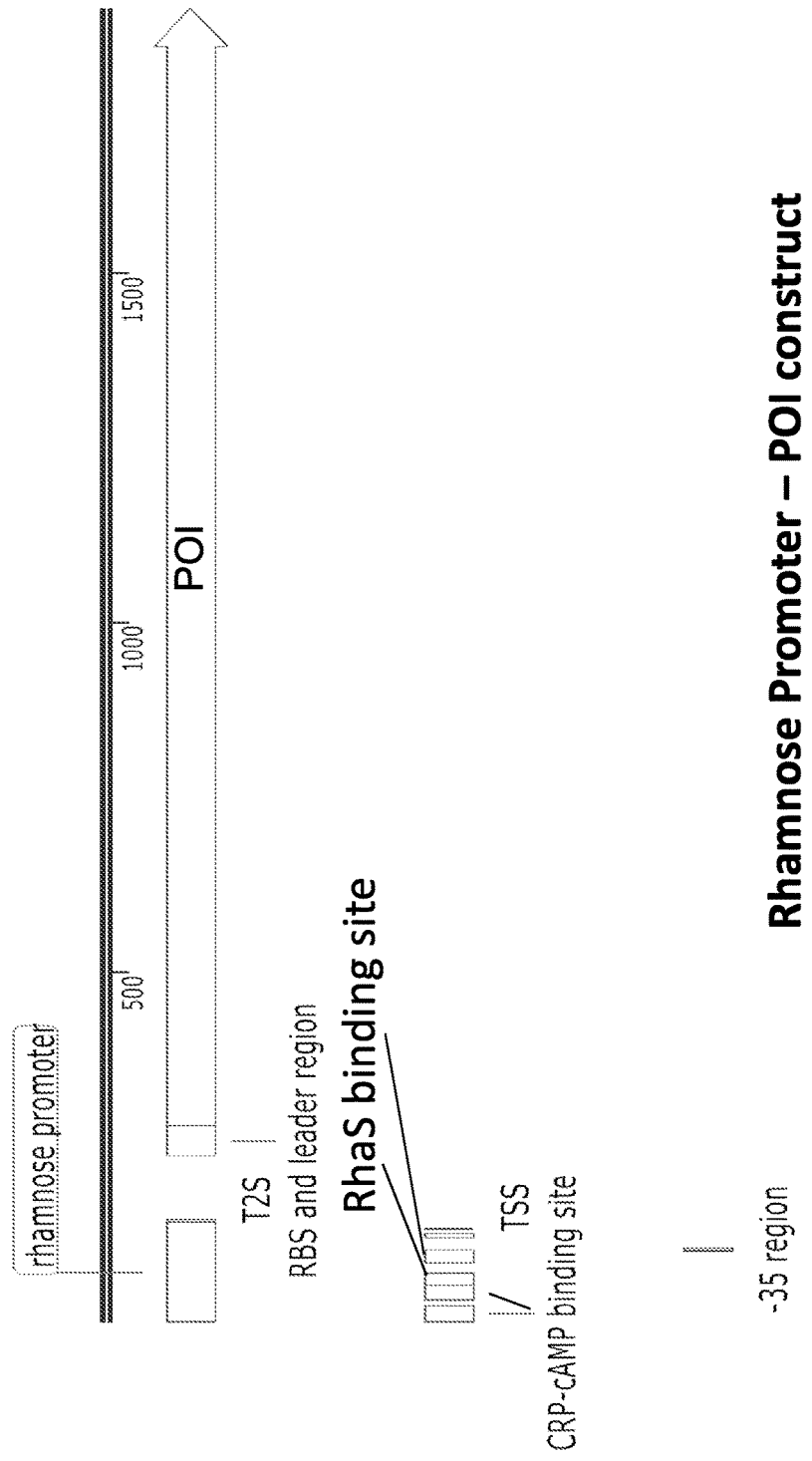
Figure 88C:
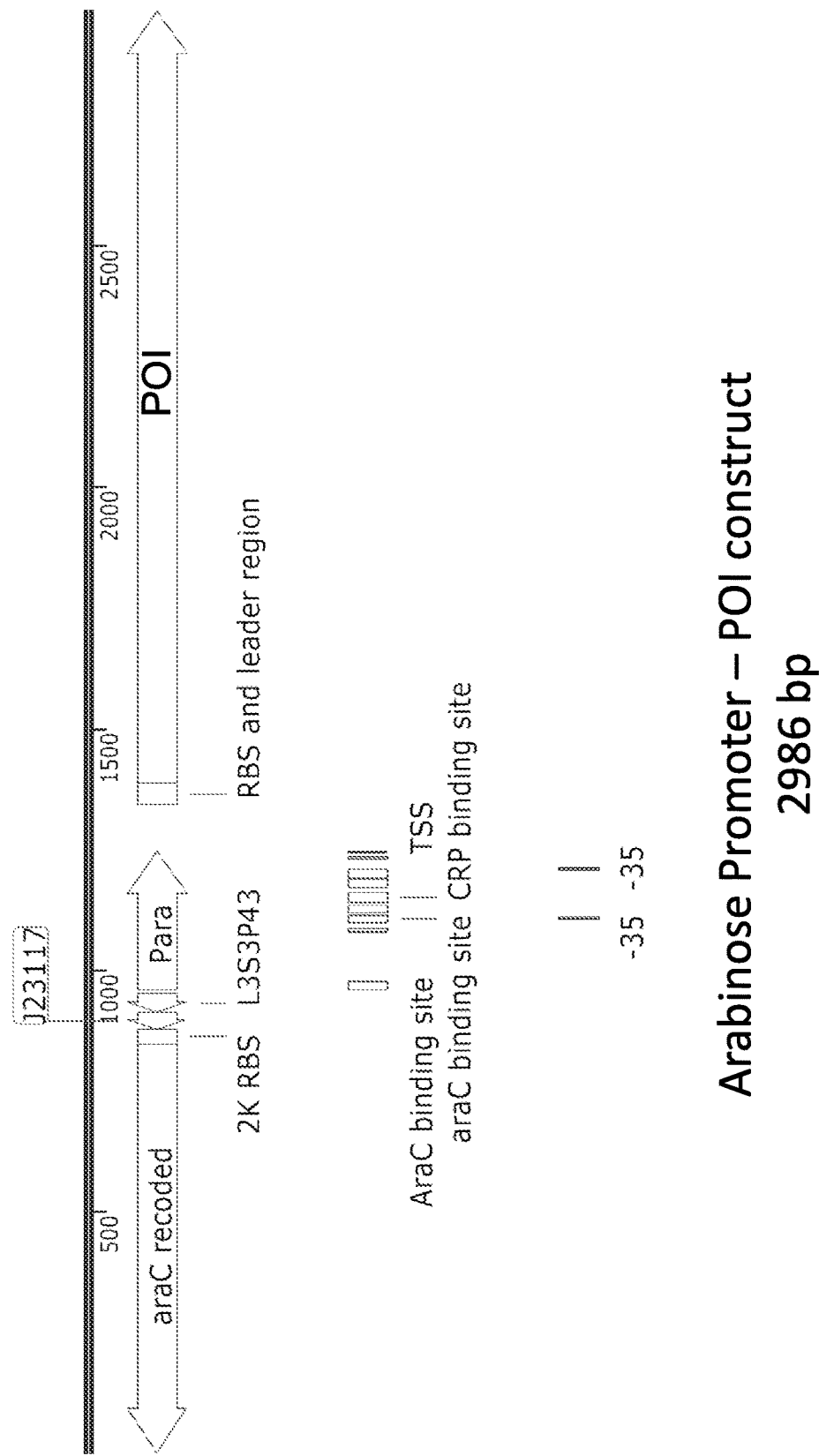

FIG. 88A, FIG. 88B, and FIG. 88C depict schematics of non-limiting examples of constructs constructs for the expression of proteins of interest POI(s). FIG. 88A depicts a schematic of a non-limiting example of the organization of a construct for POI expression under the control a lambda CI inducible promoter. The construct also provides the coding sequence of a mutant of CI, CI857, which is a temperature sensitive mutant of CI. The temperature sensitive CI repressor mutant, CI857, binds tightly at 30 degrees C. but is unable to bind (repress) at temperatures of 37 C and above. In some embodiments, this construct is used alone. In some embodiments, the temperature sensitive construct is used in combination with other constitutive or inducible POI constructs, e.g., low oxygen, arabinose, rhamnose, or IPTG inducible constructs. In some embodiments, the construct allows pre-induction and pre-loading of a POI1 and/or a POI2 prior to in vivo administration. In some embodiments, the construct provides in vivo activity. In some embodiments, the construct is located on a plasmid, e.g., a low copy or a high copy plasmid. In some embodiments, the construct is located on a plasmid component of a biosafety system. In some embodiments, the construct is integrated into the bacterial chromosome at one or more locations. In some embodiments, the construct is used in combination with a POI2 construct, which can either be provided on a plasmid or is integrated into the bacterial chromosome at one or more locations. POI2 expression may be constitutive or driven by an inducible promoter, e.g., low-oxygen, arabinose, rhamnose, or temperature sensitive. In some embodiments, the construct is used in combination with a POI3 expression construct.

In some embodiments, a temperature sensitive system can be used to set up a conditional auxotrophy. In a a strain comprising deltaThyA or deltaDapA, a dapA or thyA gene can be introduced into the strain under the control of a thermoregulated promoter system. The strain can grow in the absence of Thy and Dap only at the permissive temperature, e.g., 37 C (and not lower).

FIG. 88B depicts a schematic of a non-limiting example of the organization of a construct for POI expression under the control of a rhamnose inducible promoter. For the application of the rhamnose expression system it is not necessary to express the regulatory proteins in larger quantities, because the amounts expressed from the chromosome are sufficient to activate transcription even on multi-copy plasmids. Therefore, only the rhaP BAD promoter is cloned upstream of the gene that is to be expressed. In some embodiments, this construct is used alone. In some embodiments, the rhamnose inducible construct is used in combination with other constitutive or inducible POI constructs, e.g., low oxygen, arabinose, temperature sensitive, or IPTG inducible constructs. In some embodiments, the construct allows pre-induction and pre-loading of POI and/or POI2 and/or POI3 prior to in vivo administration. In a non-limiting example, the construct is useful for pre-induction and is combined with low-oxygen inducible constructs. In some embodiments, the construct is located on a plasmid, e.g., a low copy or a high copy plasmid. In some embodiments, the construct is located on a plasmid component of a biosafety system. In some embodiments, the construct is integrated into the bacterial chromosome at one or more locations. In some embodiments, the construct is used in combination with a POI2 construct, which can either be provided on a plasmid or is integrated into the bacterial chromosome at one or more locations. POI2 expression may be constitutive or driven by an inducible promoter, e.g., low-oxygen, arabinose, rhamnose, or temperature sensitive. In some embodiments, the construct is used in combination with a POI3 expression construct.

FIG. 88C depicts a schematic of a non-limiting example of the organization of a construct for the expression of protein(s) of interest POI(s) under the control of an arabinose inducible promoter. The arabinose inducible POI construct comprises AraC (in reverse orientation), a region comprising an Arabinose inducible promoter, and POI. In some embodiments, this construct is used alone. In some embodiments, the rhamnose inducible construct is used in combination with other constitutive or inducible POI constructs, e.g., low oxygen, arabinose, temperature sensitive, or IPTG inducible constructs. In some embodiments, the construct allows pre-induction and pre-loading of POI1 and/or POI2 and/or POI3 prior to in vivo administration. In a non-limiting example, the construct is useful for pre-induction and is combined with low-oxygen inducible constructs. In some embodiments, the construct is located on a plasmid, e.g., a low copy or a high copy plasmid. In some embodiments, the construct is located on a plasmid component of a biosafety system. In some embodiments, the construct is integrated into the bacterial chromosome at one or more locations. In some embodiments, the construct is used in combination with a POI2 construct, which can either be provided on a plasmid or is integrated into the bacterial chromosome at one or more locations. POI2 expression may be constitutive or driven by an inducible promoter, e.g., low-oxygen, arabinose, rhamnose, or temperature sensitive. In some embodiments, the construct is used in combination with a POI3 expression construct.

Figure 89A:
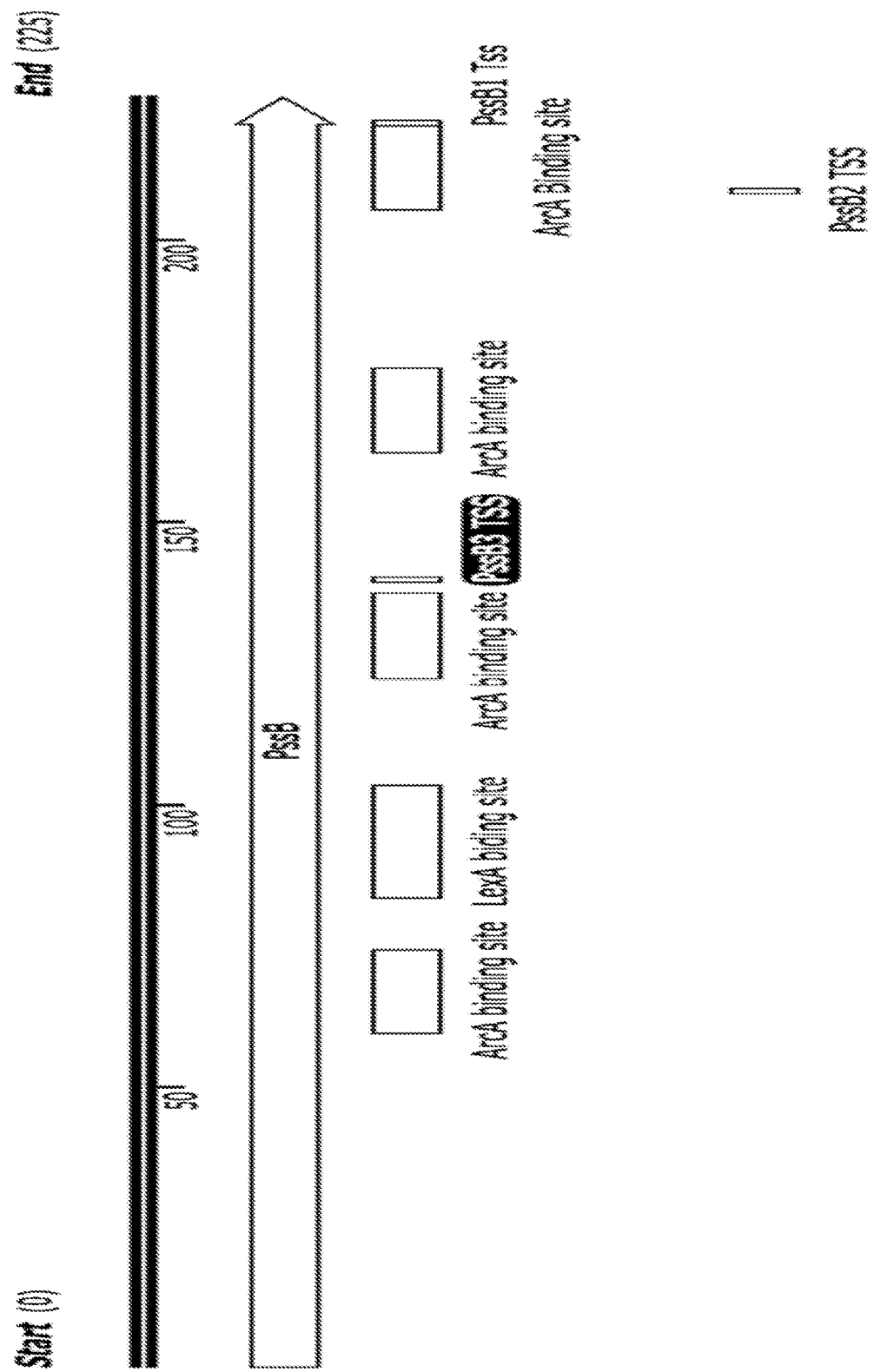

FIG. 89A depicts a schematic of the gene organization of a PssB promoter. The ssB gene product protects ssDNA from degradation; SSB interacts directly with numerous enzymes of DNA metabolism and is believed to have a central role in organizing the nucleoprotein complexes and processes involved in DNA replication (and replication restart), recombination and repair. The PssB promoter was cloned in front of a LacZ reporter and beta-galactosidase activity was measured.

Figure 89B:
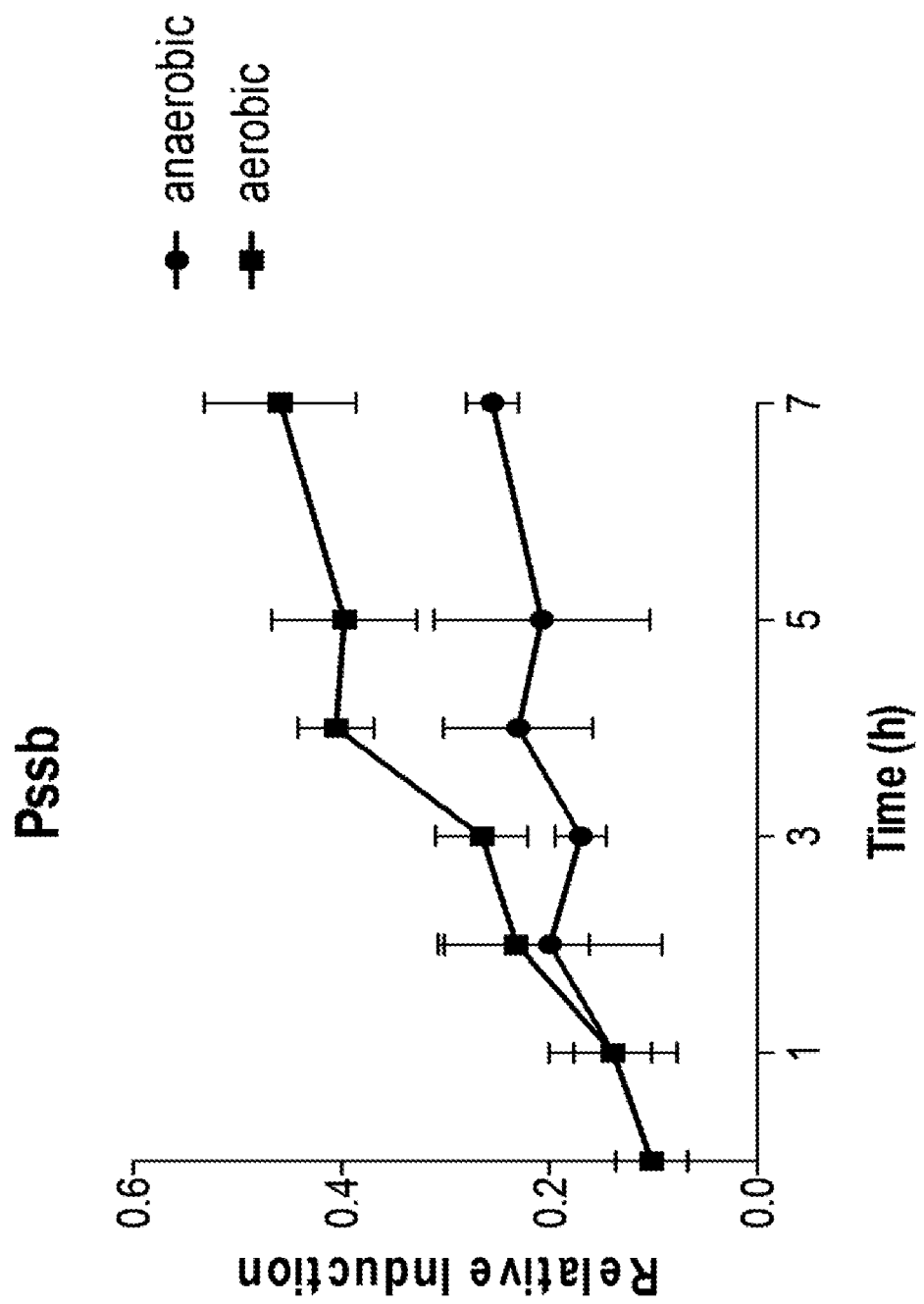

FIG. 89B depicts a bar graph showing the reporter gene activity for the PssB promoter under aerobic and anaerobic conditions. Briefly, cells were grown aerobically overnight, then diluted 1:100 and split into two different tubes. One tube was placed in the anaerobic chamber, and the other was kept in aerobic conditions for the length of the experiment. At specific times, the cells were analyzed for promoter induction. The Pssb promoter is active under aerobic conditions, and shuts off under anaerobic conditions. This promoter can be used to express a gene of interest under aerobic conditions. This promoter can also be used to tightly control the expression of a gene product such that it is only expressed under anaerobic and/or low oxygen conditions. In this case, the oxygen induced PssB promoter induces the expression of a repressor, which represses the expression of a gene of interest. Thus, the gene of interest is only expressed in the absence of the repressor, i.e., under anaerobic and/or low oxygen conditions. This strategy has the advantage of an additional level of control for improved fine-tuning and tighter control. In one non-limiting example, this strategy can be used to control expression of thyA and/or dapA, e.g., to make a conditional auxotroph. The chromosomal copy of dapA or ThyA is knocked out. Under anaerobic and/or low oxygen conditions, dapA or thyA—as the case may be— are expressed, and the strain can grow in the absence of dap or thymidine. Under aerobic conditions, dapA or thyA expression is shut off, and the strain cannot grow in the absence of dap or thymidine. Such a strategy can, for example be employed to allow survival of bacteria under anaerobic and/or low oxygen conditions, e.g., the gut, but prevent survival under aerobic conditions (biosafety switch).

Figure 90A:
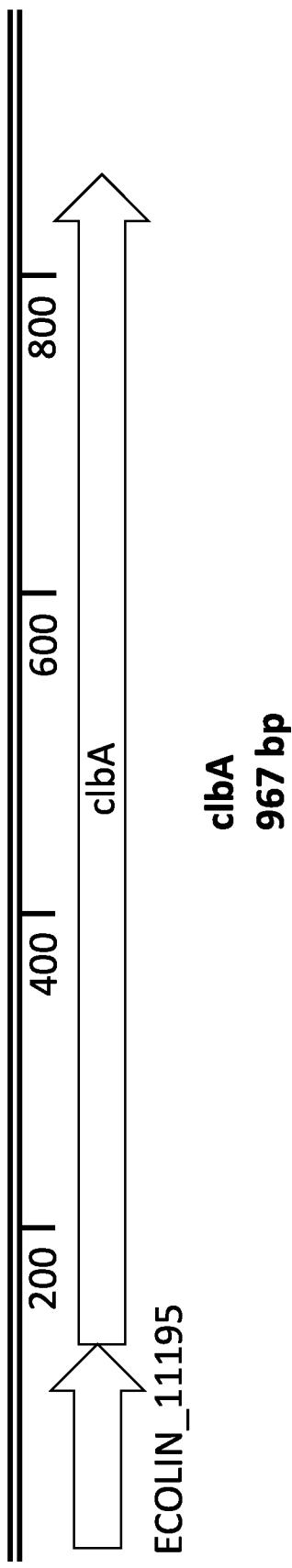

FIG. 90A depicts a schematic diagram of a wild-type clbA construct.

Figure 90B:
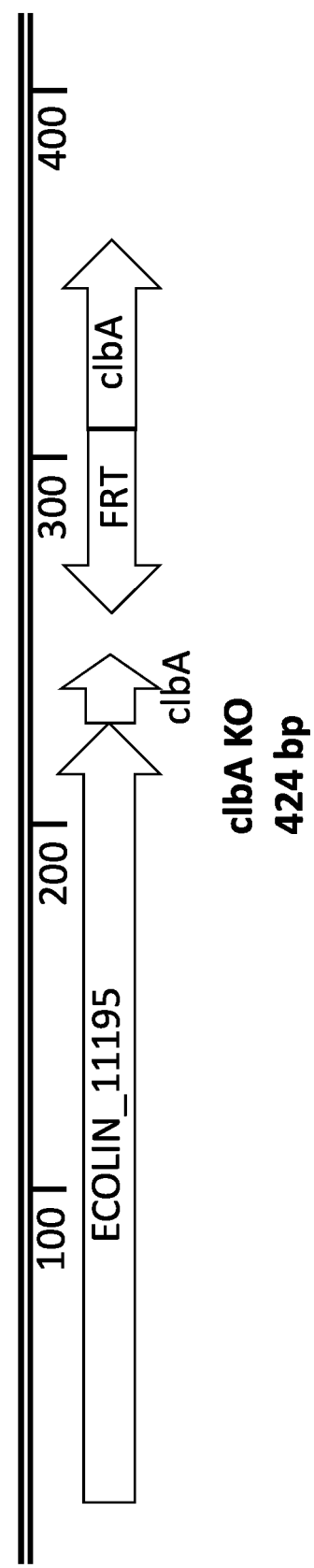

FIG. 90B depicts a schematic diagram of a clbA knockout construct.

Figure 91:
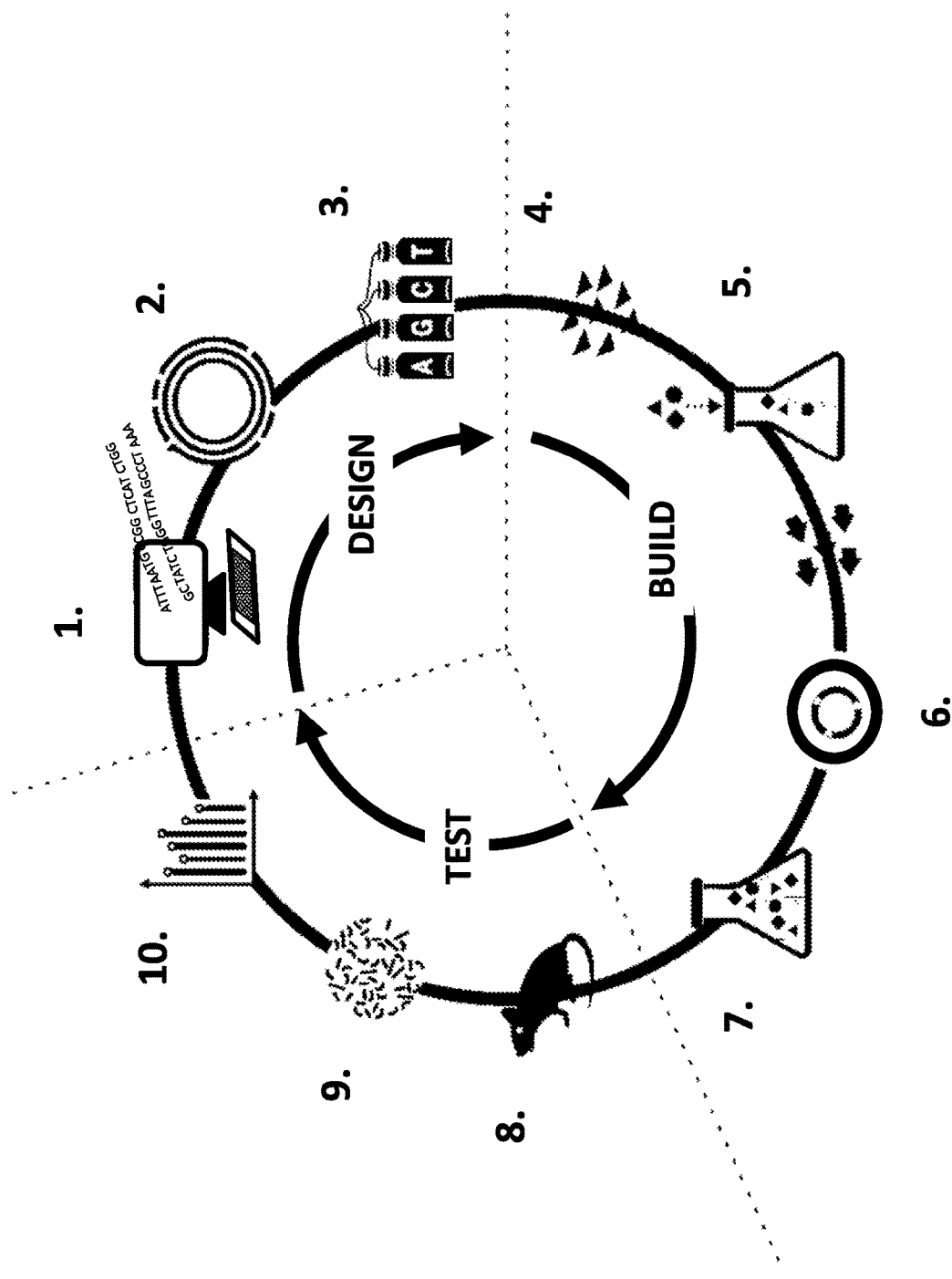

FIG. 91 depicts a schematic of a design-build-test cycle. Steps are as follows: 1: Define the disease pathway; 2. Identify target metabolites; 3. Design genetic circuits; 4. Build synthetic biotic; 5. Activate circuit in vivo; 6. Characterize circuit activation kinetics; 7. Optimize in vitro productivity to disease threshold; 8. Test optimize circuit in animal disease model; 9. Assimilate into the microbiome; 10. Develop understanding of in vivo PK and dosing regimen.

Figure 92:
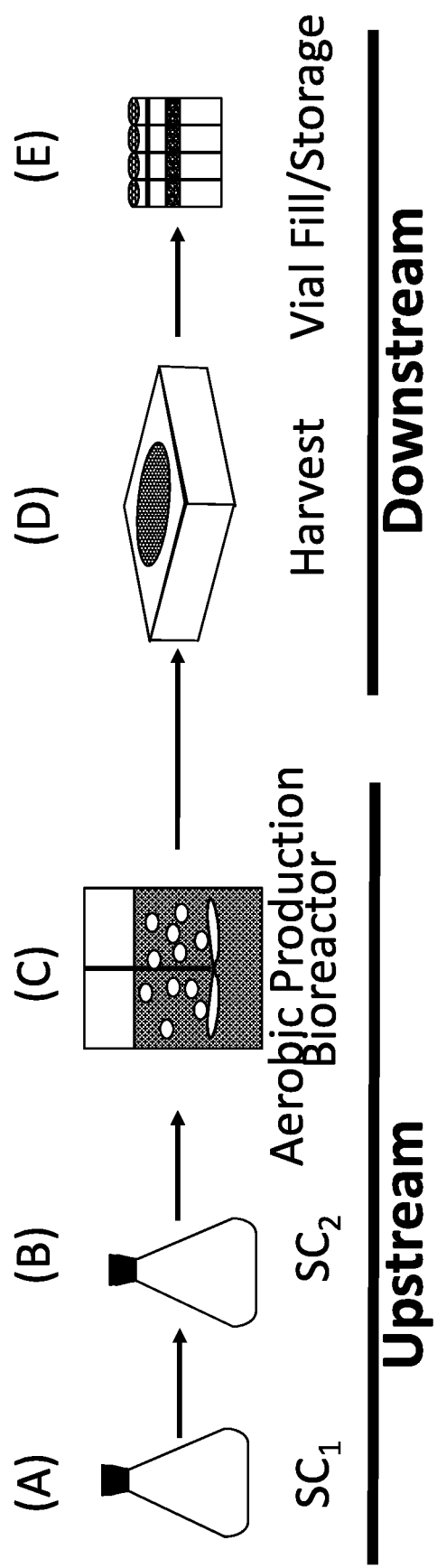

FIGS. 92A, 92B, 92C, 92D, and 92E depict a schematic of non-limiting manufacturing processes for upstream and downstream production of the genetically engineered bacteria of the present disclosure. FIG. 92A depicts the parameters for starter culture 1 (SC1): loop full—glycerol stock, duration overnight, temperature 37° C., shaking at 250 rpm. FIG. 92B depicts the parameters for starter culture 2 (SC2): 1/100 dilution from SC1, duration 1.5 hours, temperature 37° C., shaking at 250 rpm. FIG. 92C depicts the parameters for the production bioreactor: inoculum—SC2, temperature 37° C., pH set point 7.00, pH dead band 0.05, dissolved oxygen set point 50%, dissolved oxygen cascade agitation/gas FLO, agitation limits 300-1200 rpm, gas FLO limits 0.5-20 standard liters per minute, duration 24 hours. FIG. 92D depicts the parameters for harvest: centrifugation at speed 4000 rpm and duration 30 minutes, wash 1×10% glycerol/PBS, centrifugation, re-suspension 10% glycerol/PBS. FIG. 92E depicts the parameters for vial fill/storage: 1-2 mL aliquots, −80° C.

DESCRIPTION OF THE EMBODIMENTS

The invention includes genetically engineered microorganisms, e.g., genetically engineered bacteria or genetically engineered oncolytic viruses, pharmaceutical compositions thereof, and methods of modulating or treating cancer. In certain embodiments, the genetically engineered bacteria or genetically engineered oncolytic viruses are capable of targeting cancerous cells. In certain embodiments, the genetically engineered bacteria or genetically engineered oncolytic viruses are capable of targeting cancerous cells, particularly in low-oxygen conditions, such as in hypoxic tumor environments. In certain embodiments, the genetically engineered bacteria or genetically engineered oncolytic viruses are delivered locally to the tumor cells. In certain aspects, the compositions and methods disclosed herein may be used to deliver one or more anti-cancer molecules to cancerous cells or produce one or more anti-cancer molecules in cancerous cells.

This disclosure relates to compositions and therapeutic methods for the local and tumor-specific delivery of anti-cancer molecules in order to treat cancers. In certain aspects, the disclosure relates to genetically engineered microorganisms that are capable of targeting cancerous cells and producing one or more anti-cancer molecule(s), such as any of the anti-cancer molecules provided herein. In certain aspects, the disclosure relates to genetically engineered bacteria that are capable of targeting cancerous cells and producing one or more anti-cancer molecule(s). In certain aspects, the disclosure relates to genetically engineered oncolytic viruses that are capable of targeting cancerous cells and producing one or more anti-cancer molecule(s). In certain aspects, the disclosure relates to genetically engineered bacteria that are capable of targeting cancerous cells, particularly in the hypoxic regions of a tumor, and producing one or more anti-cancer molecule(s) under the control of an oxygen level-inducible promoter. In contrast to existing conventional therapies, the hypoxic areas of tumors offer a perfect niche for the growth of anaerobic bacteria, the use of which offers an opportunity for eradication of advanced local tumors in a precise manner, sparing surrounding well-vascularized, normoxic tissue.

In some aspects, the disclosure provides a genetically engineered microorganism that is capable of delivering one or more anti-cancer molecules to tumor cells or the tumor microenvironment. In some aspects, the disclosure relates to a genetically engineered microorganism that is delivered systemically, e.g., via any of the delivery means described in the present disclosure, and are capable of producing one or more anti-cancer molecule(s), such as any of the anti-cancer molecules described in the present disclosure. In some aspects, the disclosure relates to a genetically engineered microorganism that is delivered locally, e.g., via local intratumoral administration, and are capable of producing one or more anti-cancer molecule(s), such as any of the anti-cancer molecules described in the present disclosure. In some aspects, the compositions and methods disclosed herein may be used to deliver one or more anti-cancer molecules selectively to tumor cells, thereby reducing systemic cytotoxicity or systemic immune dysfunction, e.g., the onset of an autoimmune event or other immune-related adverse event.

In order that the disclosure may be more readily understood, certain terms are first defined. These definitions should be read in light of the remainder of the disclosure and as understood by a person of ordinary skill in the art. Unless defined otherwise, all technical and scientific terms used herein have the same meaning as commonly understood by a person of ordinary skill in the art. Additional definitions are set forth throughout the detailed description.

"Intratumoral administration" is meant to include any and all means for microorganism delivery to the intratumoral site and is not limited to intratumoral injection means. Examples of delivery means for the engineered microorganisms is discussed in detail herein.

"Cancer" or "cancerous" is used to refer to a physiological condition that is characterized by unregulated cell growth. In some embodiments, cancer refers to a tumor. "Tumor" is used to refer to any neoplastic cell growth or proliferation or any pre-cancerous or cancerous cell or tissue. A tumor may be malignant or benign. Types of cancer include, but are not limited to, adrenal cancer, adrenocortical carcinoma, anal cancer, appendix cancer, bile duct cancer, bladder cancer, bone cancer (e.g., Ewing sarcoma tumors, osteosarcoma, malignant fibrous histiocytoma), brain cancer (e.g., astrocytomas, brain stem glioma, craniopharyngioma, ependymoma), bronchial tumors, central nervous system tumors, breast cancer, Castleman disease, cervical cancer, colon cancer, rectal cancer, colorectal cancer, endometrial cancer, esophageal cancer, eye cancer, gallbladder cancer, gastrointestinal cancer, gastrointestinal carcinoid tumors, gastrointestinal stromal tumors, gestational trophoblastic disease, heart cancer, Kaposi sarcoma, kidney cancer, largyngeal cancer, hypopharyngeal cancer, leukemia (e.g., acute lymphoblastic leukemia, acute myeloid leukemia, chronic lymphocytic leukemia, chronic myelogenous leukemia), liver cancer, lung cancer, lymphoma (e.g., AIDS-related lymphoma, Burkitt lymphoma, cutaneous T cell lymphoma, Hodgkin lymphoma, Non-Hodgkin lymphoma, primary central nervous system lymphoma), malignant mesothelioma, multiple myeloma, myelodysplastic syndrome, nasal cavity cancer, paranasal sinus cancer, nasopharyngeal cancer, neuroblastoma, oral cavity cancer, oropharyngeal cancer, osteosarcoma, ovarian cancer, pancreatic cancer, penile cancer, pituitary tumors, prostate cancer, retinoblastoma, rhabdomyo sarcoma, rhabdoid tumor, salivary gland cancer, sarcoma, skin cancer (e.g., basal cell carcinoma, melanoma), small intestine cancer, stomach cancer, teratoid tumor, testicular cancer, throat cancer, thymus cancer, thyroid cancer, unusual childhood cancers, urethral cancer, uterine cancer, uterine sarcoma, vaginal cancer, vulvar cancer, Waldenström macroglobluliniemia, and Wilms tumor. Side effects of cancer treatment may include, but are not limited to, opportunistic autoimmune disorder(s), systemic toxicity, anemia, loss of appetite, irritation of bladder lining, bleeding and bruising (thrombocytopenia), changes in taste or smell, constipation, diarrhea, dry mouth, dysphagia, edema, fatigue, hair loss (alopecia), infection, infertility, lymphedema, mouth sores, nausea, pain, peripheral neuropathy, tooth decay, urinary tract infections, and/or problems with memory and concentration (National Cancer Institute).

"Hypoxia" is used to refer to reduced oxygen supply to a tissue as compared to physiological levels, thereby creating an oxygen-deficient environment. "Normoxia" refers to a physiological level of oxygen supply to a tissue. Hypoxia is a hallmark of solid tumors and characterized by regions of low oxygen and necrosis due to insufficient perfusion (Groot et al., 2007).

As used herein, "payload" refers to one or more molecules of interest to be produced by a genetically engineered microorganism, such as a bacteria or a virus. In some embodiments, the payload is a therapeutic payload, e.g., an anti-cancer molecule. In some embodiments, the payload is a regulatory molecule, e.g., a transcriptional regulator such as FNR. In some embodiments, the payload comprises a regulatory element, such as a promoter or a repressor. In some embodiments, the payload comprises an inducible promoter, such as from FNRS. In some embodiments the payload comprises a repressor element, such as a kill switch. In some embodiments, the payload is encoded by a gene or multiple genes or an operon. In alternate embodiments, the payload is produced by a biosynthetic or biochemical pathway, wherein the biosynthetic or biochemical pathway may optionally be endogenous to the microorganism. In some embodiments, the genetically engineered microorganism comprises two or more payloads.

As used herein, the term "low oxygen" is meant to refer to a level, amount, or concentration of oxygen ($O_2$) that is lower than the level, amount, or concentration of oxygen that is present in the atmosphere (e.g., <21% $O_2$, <160 torr $O_2$)). Thus, the term "low oxygen condition or conditions" or "low oxygen environment" refers to conditions or environments containing lower levels of oxygen than are present in the atmosphere. In some embodiments, the term "low oxygen" is meant to refer to the level, amount, or concentration of oxygen ($O_2$) found in a mammalian gut, e.g., lumen, stomach, small intestine, duodenum, jejunum, ileum, large intestine, cecum, colon, distal sigmoid colon, rectum, and anal canal. In some embodiments, the term "low oxygen" is meant to refer to a level, amount, or concentration of $O_2$ that is 0-60 mmHg $O_2$ (0-60 torr $O_2$) (e.g., 0, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, and 60 mmHg $O_2$), including any and all incremental fraction(s) thereof (e.g., 0.2 mmHg, 0.5 mmHg $O_2$, 0.75 mmHg $O_2$, 1.25 mmHg $O_2$, 2.175 mmHg $O_2$, 3.45 mmHg $O_2$, 3.75 mmHg $O_2$, 4.5 mmHg $O_2$, 6.8 mmHg $O_2$, 11.35 mmHg O2, 46.3 mmHg $O_2$, 58.75 mmHg, etc., which exemplary fractions are listed here for illustrative purposes and not meant to be limiting in any way). In some embodiments, "low oxygen" refers to about 60 mmHg $O_2$ or less (e.g., 0 to about 60 mmHg $O_2$). The term "low oxygen" may also refer to a range of $O_2$ levels, amounts, or concentrations between 0-60 mmHg $O_2$ (inclusive), e.g., 0-5 mmHg $O_2$, <1.5 mmHg $O_2$, 6-10 mmHg, <8 mmHg, 47-60 mmHg, etc. which listed exemplary ranges are listed here for illustrative purposes and not meant to be limiting in any way. See, for example, Albenberg et al., Gastroenterology, 147 (5): 1055-1063 (2014); Bergofsky et al., J Clin. Invest., 41(11): 1971-1980 (1962); Crompton et al., J Exp. Biol., 43: 473-478 (1965); He et al., PNAS (USA), 96: 4586-4591 (1999); McKeown, Br. J. Radiol., 87:20130676 (2014) (doi: 10.1259/brj.20130676), each of which discusses the oxygen levels found in the mammalian gut of various species and each of which are incorporated by reference herewith in their entireties. In some embodiments, the term "low oxygen" is meant to refer to the level, amount, or concentration of oxygen ($O_2$) found in a mammalian organ or tissue other than the gut, e.g., urogenital tract, tumor tissue, etc. in which oxygen is present at a reduced level, e.g., at a hypoxic or anoxic level. In some embodiments, "low oxygen" is meant to refer to the level, amount, or concentration of oxygen ($O_2$) present in partially aerobic, semi aerobic, microaerobic, nanoaerobic, microoxic, hypoxic, anoxic, and/or anaerobic conditions. For example, Table A summarizes the amount of oxygen present in various organs and tissues. In some embodiments, the level, amount, or concentration of oxygen ($O_2$) is expressed as the amount of dissolved oxygen ("DO") which refers to the level of free, non-compound oxygen ($O_2$) present in liquids and is typically reported in milligrams per liter (mg/L), parts per million (ppm; 1 mg/L=1 ppm), or in micromoles (umole) (1 umole $O_2$=0.022391 mg/L $O_2$). Fondriest Environmental, Inc., "Dissolved Oxygen", Fundamentals of Environmental Measurements, 19 Nov. 2013, www.fondriest.com/environmental-measurements/parameters/water-quality/dissolved-oxygen/>. In some embodiments, the term "low oxygen" is meant to refer to a level, amount, or concentration of oxygen ($O_2$) that is about 6.0 mg/L DO or less, e.g., 6.0 mg/L, 5.0 mg/L, 4.0 mg/L, 3.0 mg/L, 2.0 mg/L, 1.0 mg/L, or 0 mg/L, and any fraction therein, e.g., 3.25 mg/L, 2.5 mg/L, 1.75 mg/L, 1.5 mg/L, 1.25 mg/L, 0.9 mg/L, 0.8 mg/L, 0.7 mg/L, 0.6 mg/L, 0.5 mg/L, 0.4 mg/L, 0.3 mg/L, 0.2 mg/L and 0.1 mg/L DO, which exemplary fractions are listed here for illustrative purposes and not meant to be limiting in any way. The level of oxygen in a liquid or solution may also be reported as a percentage of air saturation or as a percentage of oxygen saturation (the ratio of the concentration of dissolved oxygen ($O_2$) in the solution to the maximum amount of oxygen that will dissolve in the solution at a certain temperature, pressure, and salinity under stable equilibrium). Well-aerated solutions (e.g., solutions subjected to mixing and/or stirring) without oxygen producers or consumers are 100% air saturated. In some embodiments, the term "low oxygen" is meant to refer to 40% air saturation or less, e.g., 40%, 39%, 38%, 37%, 36%, 35%, 34%, 33%, 32%, 31%, 30%, 29%, 28%, 27%, 26%, 25%, 24%, 23%, 22%, 21%, 20%, 19%, 18%, 17%, 16%, 15%, 14%, 13%, 12%, 11%, 10%, 9%, 8%, 7%, 6%, 5%, 4%, 3%, 2%, 1%, and 0% air saturation, including any and all incremental fraction(s) thereof (e.g., 30.25%, 22.70%, 15.5%, 7.7%, 5.0%, 2.8%, 2.0%, 1.65%, 1.0%, 0.9%, 0.8%, 0.75%, 0.68%, 0.5%. 0.44%, 0.3%, 0.25%, 0.2%, 0.1%, 0.08%, 0.075%, 0.058%, 0.04%. 0.032%, 0.025%, 0.01%, etc.) and any range of air saturation levels between 0-40%, inclusive (e.g., 0-5%, 0.05-0.1%, 0.1-0.2%, 0.1-0.5%, 0.5-2.0%, 0-10%, 5-10%, 10-15%, 15-20%, 20-25%, 25-30%, etc.). The exemplary fractions and ranges listed here are for illustrative purposes and not meant to be limiting in any way. In some embodiments, the term "low oxygen" is meant to refer to 9% $O_2$ saturation or less, e.g., 9%, 8%, 7%, 6%, 5%, 4%, 3%, 2%, 1%, 0%, $O_2$ saturation, including any and all incremental fraction(s) thereof (e.g., 6.5%, 5.0%, 2.2%, 1.7%, 1.4%, 0.9%, 0.8%, 0.75%, 0.68%, 0.5%. 0.44%, 0.3%, 0.25%, 0.2%, 0.1%, 0.08%, 0.075%, 0.058%, 0.04%. 0.032%, 0.025%, 0.01%, etc.) and any range of $O_2$ saturation levels between 0-9%, inclusive (e.g., 0-5%, 0.05-0.1%, 0.1-0.2%, 0.1-0.5%, 0.5-2.0%, 0-8%, 5-7%, 0.3-4.2% $O_2$, etc.). The exemplary fractions and ranges listed here are for illustrative purposes and not meant to be limiting in any way.

TABLE A

| Compartment | Oxygen Tension |
|---|---|
| stomach | ~60 torr (e.g., 58 +/− 15 torr) |
| duodenum and first part of jejunum | ~30 torr (e.g., 32 +/− 8 torr); ~20% oxygen in ambient air |
| Ileum (mid- small intestine) | ~10 torr; ~6% oxygen in ambient air (e.g., 11 +/− 3 torr) |
| Distal sigmoid colon | ~3 torr (e.g., 3 +/− 1 torr) |
| colon | <2 torr |
| Lumen of cecum | <1 torr |
| tumor | <32 torr (most tumors are <15 torr) |

As used herein, the term "gene" or "gene sequence" refers to any sequence expressing a polypeptide or protein, including genomic sequences, cDNA sequences, naturally occurring sequences, artificial sequences, and codon optimized sequences.

An "anti-cancer molecule" refers to one or more therapeutic substances or drugs of interest to be produced by a genetically engineered microorganism, e.g., engineered bacteria or engineered oncolytic virus, which are capable of reducing and/or inhibiting cell growth or replication. In some embodiments, the anti-cancer molecule is a therapeutic molecule that is useful for modulating or treating a cancer. In some embodiments, the anti-cancer molecule is a therapeutic molecule encoded by a gene. In alternate embodiments, the anti-cancer molecule is a therapeutic molecule produced by a biochemical or biosynthetic pathway, wherein the biosynthetic or biochemical pathway may optionally be endogenous to the microorganism. In some embodiments, the genetically engineered microorganism is capable of producing two or more anti-cancer molecules. Non-limiting examples of anti-cancer molecules include immune checkpoint inhibitors (e.g., CTLA-4 antibodies, PD-1 antibodies, PDL-1 antibodies), cytotoxic agents (e.g., Cly A, FASL, TRAIL, TNF-alpha), immunostimulatory cytokines and co-stimulatory molecules (e.g., OX40, CD28, ICOS, CCL21, IL-2, IL-18, IL-15, IL-12, IFN-gamma, IL-21, TNFs, GM-CSF), antigens and antibodies (e.g., tumor antigens, neoantigens, CtxB-PSA fusion protein, CPV-OmpA fusion protein, NY-ESO-1 tumor antigen, RAF1, antibodies against immune suppressor molecules, anti-VEGF, Anti-CXR4/CXCL12, anti-GLP1, anti-GLP2, anti-galectinl, anti-galectin3, anti-Tie2, anti-CD47, antibodies against immune checkpoints, antibodies against immunosuppressive cytokines and chemokines), DNA transfer vectors (e.g., endostatin, thrombospondin-1, TRAIL, SMAC, Stat3, Bcl2, FLT3L, GM-CSF, IL-12, AFP, VEGFR2), and enzymes (e.g., E. coli CD, HSV-TK). In some embodiments, the anti-cancer molecule includes nucleic acid molecules that mediate RNA interference, microRNA response or inhibition, TLR response, antisense gene regulation, target protein binding (aptamer or decoy oligos), gene editing, such as CRISPR interference. In some embodiments, bacteria or virus can be used as vectors to transfer DNA into mammalian cells, e.g., by bactofection (Bernardes et al., 2013). Other anti-cancer molecules are described and listed herein.

An antibody generally refers to a polypeptide of the immunoglobulin family or a polypeptide comprising fragments of an immunoglobulin that is capable of noncovalently, reversibly, and in a specific manner binding a corresponding antigen. An exemplary antibody structural unit comprises a tetramer. Each tetramer is composed of two identical pairs of polypeptide chains, each pair having one "light" (about 25 kD) and one "heavy" chain (about 50-70 kD), connected through a disulfide bond. The recognized immunoglobulin genes include the κ, λ, α, γ, δ, ε, and μ constant region genes, as well as the myriad immunoglobulin variable region genes. Light chains are classified as either κ or λ. Heavy chains are classified as γ, μ, α, δ, or ε, which in turn define the immunoglobulin classes, IgG, IgM, IgA, IgD, and IgE, respectively. The N-terminus of each chain defines a variable region of about 100 to 110 or more amino acids primarily responsible for antigen recognition. The terms variable light chain (VL) and variable heavy chain (VH) refer to these regions of light and heavy chains respectively.

As used herein, the term "antibody" or "antibodies" is meant to encompasses all variations of antibody and fragments thereof that possess one or more particular binding specificities. Thus, the term "antibody" or "antibodies" is meant to include full length antibodies, chimeric antibodies, humanized antibodies, single chain antibodies (ScFv, camelids), Fab, Fab', multimeric versions of these fragments (e.g., F(ab')2), single domain antibodies (sdAB, $V_HH$ fragments), heavy chain antibodies (HCAb), nanobodies, diabodies, and minibodies. Antibodies can have more than one binding specificity, e.g. be bispecific. The term "antibody" is also meant to include so-called antibody mimetics. Antibody mimetics refers to small molecules, e.g., 3-30 kDa, which can be single amino acid chain molecules, which can specifically bind antigens but do not have an antibody-related structure. Antibody mimetics, include, but are not limited to, Affibody molecules (Z domain of Protein A), Affilins (Gamma-B crystalline), Ubiquitin, Affimers (Cystatin), Affitins (Sac7d (from *Sulfolobus acidocaldarius*), Alphabodies (Triple helix coiled coil), Anticalins (Lipocalins), Avimers (domains of various membrane receptors), DARPins (Ankyrin repeat motif), Fynomers (SH3 domain of Fyn), Kunitz domain peptides Kunitz domains of various protease inhibitors), Ecallantide (Kalbitor), and Monobodies. In certain aspects, the term "antibody" or "antibodies" is meant to refer to a single chain antibody(ies), single domain antibody(ies), and camelid antibody(ies). Utility of antibodies in the treatment of cancer and additional anti cancer antibodies can for example be found in Scott et al., Antibody Therapy for Cancer, Nature Reviews Cancer April 2012 Volume 12, incorporated by reference in its entirety.

A "single-chain antibody" or "single-chain antibodies" typically refers to a peptide comprising a heavy chain of an immunoglobulin, a light chain of an immunoglobulin, and optionally a linker or bond, such as a disulfide bond. The single-chain antibody lacks the constant Fc region found in traditional antibodies. In some embodiments, the single-chain antibody is a naturally occurring single-chain antibody, e.g., a camelid antibody. In some embodiments, the single-chain antibody is a synthetic, engineered, or modified single-chain antibody. In some embodiments, the single-chain antibody is capable of retaining substantially the same antigen specificity as compared to the original immunoglobulin despite the addition of a linker and the removal of the constant regions. In some aspects, the single chain antibody can be a "scFv antibody", which refers to a fusion protein of the variable regions of the heavy (VH) and light chains (VL) of immunoglobulins (without any constant regions), optionally connected with a short linker peptide of ten to about 25 amino acids, as described, for example, in U.S. Pat. No. 4,946,778, the contents of which is herein incorporated by reference in its entirety. The Fv fragment is the smallest fragment that holds a binding site of an antibody, which binding site may, in some aspects, maintain the specificity of the original antibody. Techniques for the production of single chain antibodies are described in U.S. Pat. No. 4,946,778. The Vh and VL sequences of the scFv can be connected via the N-terminus of the VH connecting to the C-terminus of the VL or via the C-terminus of the VH connecting to the N-terminus of the VL. ScFv fragments are independent folding entities that can be fused indistinctively on either end to other epitope tags or protein domains. Linkers of varying length can be used to link the Vh and VL sequences, which the linkers can be glycine rich (provides flexibility) and serine or threonine rich (increases solubility). Short linkers may prevent association of the two domains and can result in multimers (diabodies, tribodies, etc.). Long linkers may result in proteolysis or weak domain association (described in Voelkel et al el., 2011). Linkers of length between 15 and 20 amino acids or 18 and 20 amino acids are most often used. Additional non-limiting examples of linkers, including other flexible linkers are described in Chen et al., 2013 (Adv Drug Deliv Rev. 2013 Oct. 15; 65(10): 1357-1369. Fusion Protein Linkers: Property, Design and Functionality), the contents of which is herein incorporated by reference in its entirety. Flexible linkers are also rich in small or polar amino acids such as Glycine and Serine, but can contain additional amino acids such as Threonine and Alanine to maintain flexibility, as well as polar amino acids such as Lysine and Glutamate to improve solubility. Exemplary linkers include, but are not limited to, (Gly-Gly-Gly-Gly-Ser)n, KESGSVSSEQLAQFRSLD and EGKSSGSGS-ESKST, (Gly)8, and Gly and Ser rich flexible linker, GSAGSAAGSGEF. "Single chain antibodies" as used herein also include single-domain antibodies, which include camelid antibodies and other heavy chain antibodies, light chain antibodies, including nanobodies and single domains VH or VL domains derived from human, mouse or other species. Single domain antibodies may be derived from any species including, but not limited to mouse, human, camel, llama, fish, shark, goat, rabbit, and bovine. Single domain antibodies include domain antigen-binding units which have a camelid scaffold, derived from camels, llamas, or alpacas. Camelids produce functional antibodies devoid of light chains. The heavy chain variable (VH) domain folds autonomously and functions independently as an antigen-binding unit. Its binding surface involves only three CDRs as compared to the six CDRs in classical antigen-binding molecules (Fabs) or single chain variable fragments (scFvs). Camelid antibodies are capable of attaining binding affinities comparable to those of conventional antibodies. Camelid scaffold-based antibodies can be produced using methods well known in the art. Cartilaginous fishes also have heavy-chain antibodies (IgNAR, 'immunoglobulin new antigen receptor'), from which single-domain antibodies called VNAR fragments can be obtained. Alternatively, the dimeric variable domains from IgG from humans or mice can be split into monomers. Nanobodies are single chain antibodies derived from light chains. The term "single chain antibody" also refers to antibody mimetics.

In some embodiments, the antibodies expressed by the engineered microorganisms are bispecfic. In certain embodiments, a bispecific antibody molecule comprises a scFv, or fragment thereof, have binding specificity for a first epitope and a scFv, or fragment thereof, have binding specificity for a second epitope. Antigen-binding fragments or antibody portions include bivalent scFv (diabody), bispecific scFv antibodies where the antibody molecule recognizes two different epitopes, single binding domains (dAbs), and minibodies. Monomeric single-chain diabodies (scDb) are readily assembled in bacterial and mammalian cells and show improved stability under physiological conditions (Voelkel et al., 2001 and references therein; Protein Eng. (2001) 14 (10): 815-823 (describes optimized linker sequences for the expression of monomeric and dimeric bispecific single-chain diabodies).

As used herein, the term "polypeptide" includes "polypeptide" as well as "polypeptides," and refers to a molecule composed of amino acid monomers linearly linked by amide bonds (i.e., peptide bonds). The term "polypeptide" refers to any chain or chains of two or more amino acids, and does not refer to a specific length of the product. Thus, "peptides," "dipeptides," "tripeptides, "oligopeptides," "protein," "amino acid chain," or any other term used to refer to a chain or chains of two or more amino acids, are included within the definition of "polypeptide," and the term "polypeptide" may be used instead of, or interchangeably with any of these terms. The term "polypeptide" is also intended to refer to the products of post-expression modifications of the polypeptide, including but not limited to glycosylation, acetylation, phosphorylation, amidation, derivatization, proteolytic cleavage, or modification by non-naturally occurring amino acids. A polypeptide may be derived from a natural biological source or produced by recombinant technology. In other embodiments, the polypeptide is produced by the genetically engineered bacteria or OVs of the current invention. A polypeptide of the invention may be of a size of about 3 or more, 5 or more, 10 or more, 20 or more, 25 or more, 50 or more, 75 or more, 100 or more, 200 or more, 500 or more, 1,000 or more, or 2,000 or more amino acids. Polypeptides may have a defined three-dimensional structure, although they do not necessarily have such structure. Polypeptides with a defined three-dimensional structure are referred to as folded, and polypeptides, which do not possess a defined three-dimensional structure, but rather can adopt a large number of different conformations, are referred to as unfolded.

An "isolated" polypeptide or a fragment, variant, or derivative thereof refers to a polypeptide that is not in its natural milieu. No particular level of purification is required. Recombinantly produced polypeptides and proteins expressed in host cells, including but not limited to bacterial or mammalian cells, are considered isolated for purposed of the invention, as are native or recombinant polypeptides which have been separated, fractionated, or partially or substantially purified by any suitable technique. Recombinant peptides, polypeptides or proteins refer to peptides, polypeptides or proteins produced by recombinant DNA techniques, i.e. produced from cells, microbial or mammalian, transformed by an exogenous recombinant DNA expression construct encoding the polypeptide. Proteins or peptides expressed in most bacterial cultures will typically be free of glycan. Fragments, derivatives, analogs or variants of the foregoing polypeptides, and any combination thereof are also included as polypeptides. The terms "fragment," "variant," "derivative" and "analog" include polypeptides having an amino acid sequence sufficiently similar to the amino acid sequence of the original peptide and include any polypeptides, which retain at least one or more properties of the corresponding original polypeptide. Fragments of polypeptides of the present invention include proteolytic fragments, as well as deletion fragments. Fragments also include specific antibody or bioactive fragments or immunologically active fragments derived from any polypeptides described herein. Variants may occur naturally or be non-naturally occurring. Non-naturally occurring variants may be produced using mutagenesis methods known in the art. Variant polypeptides may comprise conservative or non-conservative amino acid substitutions, deletions or additions.

Polypeptides also include fusion proteins. As used herein, the term "variant" includes a fusion protein, which comprises a sequence of the original peptide or sufficiently similar to the original peptide. As used herein, the term "fusion protein" refers to a chimeric protein comprising amino acid sequences of two or more different proteins. Typically, fusion proteins result from well known in vitro recombination techniques. Fusion proteins may have a similar structural function (but not necessarily to the same extent), and/or similar regulatory function (but not necessarily to the same extent), and/or similar biochemical function (but not necessarily to the same extent) and/or immunological activity (but not necessarily to the same extent) as the individual original proteins which are the components of the fusion proteins. "Derivatives" include but are not limited to peptides, which contain one or more naturally occurring amino acid derivatives of the twenty standard amino acids. "Similarity" between two peptides is determined by comparing the amino acid sequence of one peptide to the sequence of a second peptide. An amino acid of one peptide is similar to the corresponding amino acid of a second peptide if it is identical or a conservative amino acid substitution. Conservative substitutions include those described in Dayhoff, M. O., ed., The Atlas of Protein Sequence and Structure 5, National Biomedical Research Foundation, Washington, D.C. (1978), and in Argos, EMBO J. 8 (1989), 779-785. For example, amino acids belonging to one of the following groups represent conservative changes or substitutions: -Ala, Pro, Gly, Gln, Asn, Ser, Thr; -Cys, Ser, Tyr, Thr; -Val, Ile, Leu, Met, Ala, Phe; -Lys, Arg, His; -Phe, Tyr, Trp, His; and -Asp, Glu.

As used herein, the term "sufficiently similar" means a first amino acid sequence that contains a sufficient or minimum number of identical or equivalent amino acid residues relative to a second amino acid sequence such that the first and second amino acid sequences have a common structural domain and/or common functional activity. For example, amino acid sequences that comprise a common structural domain that is at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100%, identical are defined herein as sufficiently similar Preferably, variants will be sufficiently similar to the amino acid sequence of the peptides of the invention. Such variants generally retain the functional activity of the peptides of the present invention. Variants include peptides that differ in amino acid sequence from the native and wt peptide, respectively, by way of one or more amino acid deletion(s), addition(s), and/or substitution(s). These may be naturally occurring variants as well as artificially designed ones.

As used herein the term "linker", "linker peptide" or "peptide linkers" or "linker" refers to synthetic or non-native or non-naturally-occurring amino acid sequences that connect or link two polypeptide sequences, e.g., that link two polypeptide domains. As used herein the term "synthetic" refers to amino acid sequences that are not naturally occurring. Exemplary linkers are described herein. Additional exemplary linkers are provided in US 20140079701, the contents of which are herein incorporated by reference in its entirety.

As used herein the term "codon-optimized sequence" refers to a sequence, which was modified from an existing coding sequence, or designed, for example, to improve translation in an expression host cell or organism of a transcript RNA molecule transcribed from the coding sequence, or to improve transcription of a coding sequence. Codon optimization includes, but is not limited to, processes including selecting codons for the coding sequence to suit the codon preference of the expression host organism.

Many organisms display a bias or preference for use of particular codons to code for insertion of a particular amino acid in a growing polypeptide chain. Codon preference or codon bias, differences in codon usage between organisms, is allowed by the degeneracy of the genetic code, and is well documented among many organisms. Codon bias often correlates with the efficiency of translation of messenger RNA (mRNA), which is in turn believed to be dependent on, inter alia, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization.

As used herein, the terms "secretion system" or "secretion protein" refers to a native or non-native secretion mechanism capable of secreting or exporting the anti-cancer molecule from the microbial, e.g., bacterial cytoplasm. The secretion system may comprise a single protein or may comprise two or more proteins assembled in a complex e.g., HlyBD. Non-limiting examples of secretion systems for gram negative bacteria include the modified type III flagellar, type I (e.g., hemolysin secretion system), type II, type IV, type V, type VI, and type VII secretion systems, resistance-nodulation-division (RND) multi-drug efflux pumps, various single membrane secretion systems. Non-liming examples of secretion systems for gram positive bacteria include Sec and TAT secretion systems. In some embodiments, the anti-cancer molecule(s) include a "secretion tag" of either RNA or peptide origin to direct the anti-cancer molecule(s) to specific secretion systems. In some embodiments, the secretion system is able to remove this tag before secreting the anti-cancer molecule from the engineered bacteria. For example, in Type V auto-secretion-mediated secretion the N-terminal peptide secretion tag is removed upon translocation of the "passenger" peptide from the cytoplasm into the periplasmic compartment by the native Sec system. Further, once the auto-secretor is translocated across the outer membrane the C-terminal secretion tag can be removed by either an autocatalytic or protease-catalyzed e.g., OmpT cleavage thereby releasing the anti-cancer molecule(s) into the extracellular milieu.

As used herein, the term "transporter" is meant to refer to a mechanism, e.g., protein or proteins, for importing a molecule into the microorganism from the extracellular milieu.

The immune system is typically divided into two categories—innate immunity and adaptive immunity—although the immune responses associated with these immunities are not mutually exclusive. "Innate immunity" refers to non-specific defense mechanisms that are activated immediately or within hours of a foreign agent's or antigen's appearance in the body. These mechanisms include physical barriers such as skin, chemicals in the blood, and immune system cells, such as dendritic cells (DCs), leukocytes, phagocytes, macrophages, neutrophils, and natural killer cells (NKs), that attack foreign agents or cells in the body. Also, during an innate immune response, cytokines are produced which activate the adaptive immune response. "Adaptive immunity" or "acquired immunity" refers to antigen-specific immune response and is more complex than the innate immune response. The antigen must first be processed or "presented" by antigen presenting cells (APCs). An antigen-presenting cell or accessory cell is a cell that displays antigen complexed with major histocompatibility complexes (MHCs) on their surfaces. Professional antigen-presenting cells, including macrophages, B cells, and dendritic cells, specialize in presenting foreign antigen to T helper cells, while other cell types can present antigen originating inside the cell to cytotoxic T cells. Once an antigen has been presented and recognized, the adaptive immune system activates an army of immune cells specifically designed to attack that antigen. Like the innate system, the adaptive system includes both humoral immunity components (B lymphocyte cells) and cell-mediated immunity (T lymphocyte cells) components. B cells are activated to secrete antibodies, which travel through the bloodstream and bind to the foreign antigen. Helper T cells (regulatory T cells, CD4+ cells) and cytotoxic T cells (CTL, CD8+ cells) are activated when their T cell receptor interacts with an antigen-bound MHC class I molecule. Cytokines help the T cells mature, which mature cells, in turn, produce cytokines which allows the production of additional T cells. Once activated, the helper T cells release cytokines which regulate and direct the activity of different immune cell types, including APCs, macrophages, neutrophils, and other lymphocytes, to kill and remove targeted cells. T helper cells have no cytotoxic or phagocytic activity themselves, instead acting as immune response mediators which direct other cells to perform these tasks. Helper T cells also secrete extra signals that assist in the activation of cytotoxic T cells. Upon activation, CTL undergoes clonal selection, in which it gains functions and divides rapidly to produce an army of activated effector cells. Activated CTL then travels throughout the body searching for cells that bear that unique MHC Class I and antigen. The effector CTLs release cytotoxins that form pores in the target cell's plasma membrane, causing apoptosis. Adaptive immunity also includes a "memory" that makes future responses against a specific antigen more efficient. Upon resolution of the infection, T helper cells and cytotoxic T cells die and are cleared away by phagocytes, however, a few of these cells remain as memory cells. If the same antigen is encountered at a later time, these memory cells quickly differentiate into effector cells, shortening the time required to mount an effective response.

An "immune checkpoint inhibitor" or "immune checkpoint" refers to a molecule that completely or partially reduces, inhibits, interferes with, or modulates one or more immune checkpoint proteins. Immune checkpoint proteins regulate T-cell activation or function, and are known in the art. Non-limiting examples include CTLA-4 and its ligands CD 80 and CD86, and PD-1 and its ligands PD-L1 and PD-L2. Immune checkpoint proteins are responsible for co-stimulatory or inhibitory interactions of T-cell responses, and regulate and maintain self-tolerance and physiological immune responses. Systemic immunotherapy, e.g., using CTLA-4 inhibitors, may alter immunoregulation, provoke immune dysfunction, and result in opportunistic autoimmune disorders (see, e.g., Kong et al., 2014).

A "co-stimulatory" molecule is an immune modulator that increase or activates a signal that stimulates an immune response or inflammatory response. A co-stimulatory molecule could be considered an immune checkpoint (immune checkpoints are molecules in the immune system that either turn up a signal (co-stimulatory molecules) or turn down a signal), but as used herein, a co-stimulatory molecule is not referred to as an immune checkpoint and instead is referred to as a co-stimulator. Thus, as used herein, "immune checkpoint" is meant to refer to an inhibitory immune checkpoint and not a co-stimulatory molecule.

As used herein, a genetically engineered microorganism, e.g., engineered bacterium or engineered oncolytiv virus, or anti-cancer molecule that "inhibits" cancerous cells refers to a bacterium or virus or molecule that is capable of reducing cell proliferation, reducing tumor growth, and/or reducing tumor volume by at least about 10%, 20%, 25%, 30%, 40%, 50%, 60%, 70%, 75%, 80%, 85%, 90%, 95%, or more as compared to control, e.g., an untreated control or an unmodified microorganism of the same subtype under the same conditions.

As used herein, a genetically engineered microorganism, e.g., engineered bacterium or engineered oncolytic virus, or anti-cancer molecule that "inhibits" a biological molecule, such as an immune modulator, e.g., cytokine, chemokine, immune modulatory metabolite, or any other immune modulatory agent, factor, or molecule, refers to a bacterium or virus or anti-cancer molecule that is capable of reducing, decreasing, or eliminating the biological activity, biological function, and/or number of that biological molecule, e.g., immune modulator, as compared to control, e.g., an untreated control or an unmodified microorganism of the same subtype under the same conditions.

As used herein, a genetically engineered microorganism, e.g., engineered bacterium or engineered oncolytic virus, or anti-cancer molecule that "activates" or "stimulates" a biological molecule, such as an immune modulator, e.g., cytokine, chemokine, immune modulatory metabolite, or any other immune modulatory agent, factor, or molecule, refers to a bacterium or virus or anti-cancer molecule that is capable of activating, increasing, enhancing, or promoting the biological activity, biological function, and/or number of that biological molecule, e.g., immune modulator, as compared to control, e.g., an untreated control or an unmodified microorganism of the same subtype under the same conditions.

"Tumor-targeting bacteria" refer to bacteria that are capable of directing themselves to cancerous cells. Tumor-targeting bacteria may be naturally capable of directing themselves to cancerous cells, necrotic tissues, and/or hypoxic tissues. In some embodiments, bacteria that are not naturally capable of directing themselves to cancerous cells, necrotic tissues, and/or hypoxic tissues are genetically engineered to direct themselves to cancerous cells, necrotic tissues, and/or hypoxic tissues. Tumor-targeting bacteria may be further engineered to enhance or improve desired biological properties, mitigate systemic toxicity, and/or ensure clinical safety. These species, strains, and/or subtypes may be attenuated, e.g., deleted for a toxin gene. In some embodiments, tumor-targeting bacteria have low infection capabilities. In some embodiments, tumor-targeting bacteria are motile. In some embodiments, the tumor-targeting bacteria are capable of penetrating deeply into the tumor, where standard treatments do not reach. In some embodiments, tumor-targeting bacteria are capable of colonizing at least 20%, at least 30%, at least 40%, at least 50%, at least 60%, at least 70%, at least 80%, at least 90%, or at least 95% of a malignant tumor. Examples of tumor-targeting bacteria include, but are not limited to, *Bifidobacterium, Caulobacter, Clostridium, Escherichia coli, Listeria, Mycobacterium, Salmonella, Streptococcus,* and *Vibrio,* e.g., *Bifidobacterium adolescentis, Bifidobacterium bifidum, Bifidobacterium breve* UCC2003, *Bifidobacterium infantis, Bifidobacterium longum, Clostridium acetobutylicum, Clostridium butyricum, Clostridium butyricum* M-55, *Clostridium butyricum miyairi, Clostridium cochlearum, Clostridium felsineum, Clostridium histolyticum, Clostridium multifermentans, Clostridium novyi*-NT, *Clostridium paraputrificum, Clostridium pasteureanum, Clostridium pectinovorum, Clostridium perfringens, Clostridium roseum, Clostridium sporogenes, Clostridium tertium, Clostridium tetani, Clostridium tyrobutyricum, Corynebacterium parvum, Escherichia coli* MG1655, *Escherichia coli* Nissle 1917, *Listeria monocytogenes, Mycobacterium bovis, Salmonella choleraesuis, Salmonella typhimurium,* and *Vibrio cholera* (Cronin et al., 2012; Forbes, 2006; Jain and Forbes, 2001; Liu et al., 2014; Morrissey et al., 2010; Nuno et al., 2013; Patyar et al., 2010; Cronin, et al., Mol Ther 2010; 18:1397-407). In some embodiments, the tumor-targeting bacteria are non-pathogenic bacteria.

"Tumor-targeting oncolytic virus" refer to virus that are capable of directing themselves to cancerous cells. Tumor-targeting virus may be naturally capable of directing themselves to cancerous cells, necrotic tissues, and/or hypoxic tissues. Oncolytic viruses that are not naturally capable of directing themselves to cancerous cells, necrotic tissues, and/or hypoxic tissues can be genetically engineered to direct themselves to cancerous cells, necrotic tissues, and/or hypoxic tissues. In addition, they can be further engineered to target specific cancer or cell types. Tumor-targeting oncolytic viruses may also be engineered to enhance or improve desired biological properties (e.g., lytic properties), mitigate systemic toxicity, and/or ensure clinical safety. These species, strains, and/or subtypes may be attenuated, e.g., deleted for a toxin gene. In some embodiments, tumor-targeting bacteria have low infection capabilities. Examples of tumor-targeting oncolytic viruses are provided elsewhere herein and are reviewed in Chlocca et al., Cancer Immunol research, 2014, 2:295-300 and Kaufman, et al., Nature, 2016, 14:642-662.

"Microorganism" refers to an organism or microbe of microscopic, submicroscopic, or ultramicroscopic size that typically consists of a single cell. Examples of microrganisms include bacteria, viruses, parasites, fungi, certain algae, protozoa, and yeast. In some aspects, the microorganism is engineered ("engineered microorganism") to produce one or more anti-cancer molecules. In certain embodiments, the engineered microorganism is an engineered bacterium. In certain embodiments, the engineered microorganism is an engineered oncolytic virus.

As used herein, the term "recombinant microorganism" refers to a microorganism, e.g., bacterial, yeast, or viral cell, or bacteria, yeast, or virus, that has been genetically modified from its native state. Thus, a "recombinant bacterial cell" or "recombinant bacteria" refers to a bacterial cell or bacteria that have been genetically modified from their native state. For instance, a recombinant bacterial cell may have nucleotide insertions, nucleotide deletions, nucleotide rearrangements, and nucleotide modifications introduced into their DNA. These genetic modifications may be present in the chromosome of the bacteria or bacterial cell, or on a plasmid in the bacteria or bacterial cell. Recombinant bacterial cells disclosed herein may comprise exogenous nucleotide sequences on plasmids. Alternatively, recombinant bacterial cells may comprise exogenous nucleotide sequences stably incorporated into their chromosome.

A "programmed or engineered microorganism" refers to a microorganism, e.g., bacterial, yeast, or viral cell, or bacteria, yeast, or virus, that has been genetically modified from its native state to perform a specific function. Thus, a "programmed or engineered bacterial cell" or "programmed or engineered bacteria" refers to a bacterial cell or bacteria that has been genetically modified from its native state to perform a specific function. In certain embodiments, the programmed or engineered bacterial cell has been modified to express one or more proteins, for example, one or more proteins that have a therapeutic activity or serve a therapeutic purpose. The programmed or engineered bacterial cell may additionally have the ability to stop growing or to destroy itself once the protein(s) of interest have been expressed.

"Non-pathogenic bacteria" refer to bacteria that are not capable of causing disease or harmful responses in a host. In some embodiments, non-pathogenic bacteria are Gram-negative bacteria. In some embodiments, non-pathogenic bacteria are Gram-positive bacteria. In some embodiments, non-pathogenic bacteria do not contain lipopolysaccharides (LPS). In some embodiments, non-pathogenic bacteria are commensal bacteria. Examples of non-pathogenic bacteria include, but are not limited to certain strains belonging to the genus *Bacillus, Bacteroides, Bifidobacterium, Brevibacteria, Clostridium, Enterococcus, Escherichia coli, Lactobacillus, Lactococcus, Saccharomyces,* and *Staphylococcus*, e.g., *Bacillus coagulans, Bacillus subtilis, Bacteroides fragilis, Bacteroides subtilis, Bacteroides thetaiotaomicron, Bifidobacterium bifidum, Bifidobacterium infantis, Bifidobacterium lactis, Bifidobacterium longum, Clostridium butyricum, Enterococcus faecium, Escherichia coli* Nissle, *Lactobacillus acidophilus, Lactobacillus bulgaricus, Lactobacillus casei, Lactobacillus johnsonii, Lactobacillus paracasei, Lactobacillus plantarum, Lactobacillus reuteri, Lactobacillus rhamnosus, Lactococcus lactis,* and *Saccharomyces boulardii* (Sonnenborn et al., 2009; Dinleyici et al., 2014; U.S. Pat. Nos. 6,835,376; 6,203,797; 5,589,168; 7,731,976). Naturally pathogenic bacteria may be genetically engineered to provide reduce or eliminate pathogenicity.

"Probiotic" is used to refer to live, non-pathogenic microorganisms, e.g., bacteria, which can confer health benefits to a host organism that contains an appropriate amount of the microorganism. In some embodiments, the host organism is a mammal. In some embodiments, the host organism is a human. In some embodiments, the probiotic bacteria are Gram-negative bacteria. In some embodiments, the probiotic bacteria are Gram-positive bacteria. Some species, strains, and/or subtypes of non-pathogenic bacteria are currently recognized as probiotic bacteria. Examples of probiotic bacteria include, but are not limited to certain strains belonging to the genus *Bifidobacteria, Escherichia coli, Lactobacillus,* and *Saccharomyces,* e.g., *Bifidobacterium bifidum, Enterococcus faecium, Escherichia coli* strain Nissle, *Lactobacillus acidophilus, Lactobacillus bulgaricus, Lactobacillus paracasei, Lactobacillus plantarum,* and *Saccharomyces boulardii* (Dinleyici et al., 2014; U.S. Pat. Nos. 5,589,168; 6,203,797; 6,835,376). The probiotic may be a variant or a mutant strain of bacterium (Arthur et al., 2012; Cuevas-Ramos et al., 2010; Olier et al., 2012; Nougayrede et al., 2006). Non-pathogenic bacteria may be genetically engineered to enhance or improve desired biological properties, e.g., survivability. Non-pathogenic bacteria may be genetically engineered to provide probiotic properties. Probiotic bacteria may be genetically engineered or programmed to enhance or improve probiotic properties.

As used herein, an "oncolytic virus" (OV) is a virus having the ability to specifically infect and lyse cancer cells, while leaving normal cells unharmed. Oncolytic viruses of interest include, but are not limited to adenovirus, Coxsackie, Reovirus, herpes simplex virus (HSV), vaccinia, fowlpox, vesicular stomatitis virus (VSV), measles, and Parvovirus, and also includes rabies, west nile virus, New castle disease and genetically modified versions thereof. A non-limiting example of an OV is Talimogene Laherparepvec (T-VEC), the first oncolytic virus to be licensed by the FDA as a cancer therapeutic.

"Operably linked" refers a nucleic acid sequence, e.g., a gene encoding a CTLA-4 inhibitor, that is joined to a regulatory region sequence in a manner which allows expression of the nucleic acid sequence, e.g., acts in cis. A regulatory region is a nucleic acid that can direct transcription of a gene of interest and may comprise promoter sequences, enhancer sequences, response elements, protein recognition sites, inducible elements, promoter control elements, protein binding sequences, 5' and 3' untranslated regions, transcriptional start sites, termination sequences, polyadenylation sequences, and introns.

An "inducible promoter" refers to a regulatory region that is operably linked to one or more genes, wherein expression of the gene(s) is increased in the presence of an inducer of said regulatory region.

"Exogenous environmental condition(s)" refer to setting(s) or circumstance(s) under which the promoter described herein is induced. In some embodiments, the exogenous environmental conditions are specific to a malignant growth containing cancerous cells, e.g., a tumor. The phrase "exogenous environmental conditions" is meant to refer to the environmental conditions external to the intact (unlysed) engineered microorganism, but endogenous or native to tumor environment or the host subject environment. Thus, "exogenous" and "endogenous" may be used interchangeably to refer to environmental conditions in which the environmental conditions are endogenous to a mammalian body, but external or exogenous to an intact microorganism cell. In some embodiments, the exogenous environmental conditions are low-oxygen, microaerobic, or anaerobic conditions, such as hypoxic and/or necrotic tissues. Some solid tumors are associated with low intracellular and/or extracellular pH; in some embodiments, the exogenous environmental condition is a low-pH environment. In some embodiments, the genetically engineered microorganism of the disclosure comprise a pH-dependent promoter. In some embodiments, the genetically engineered microorganism of the disclosure comprise an oxygen level-dependent promoter. In some aspects, bacteria have evolved transcription factors that are capable of sensing oxygen levels. Different signaling pathways may be triggered by different oxygen levels and occur with different kinetics. An "oxygen level-dependent promoter" or "oxygen level-dependent regulatory region" refers to a nucleic acid sequence to which one or more oxygen level-sensing transcription factors is capable of binding, wherein the binding and/or activation of the corresponding transcription factor activates downstream gene expression.

Examples of oxygen level-dependent transcription factors include, but are not limited to, FNR (fumarate and nitrate reductase), ANR, and DNR. Corresponding FNR-responsive promoters, ANR (anaerobic nitrate respiration)-responsive promoters, and DNR (dissimilatory nitrate respiration regulator)-responsive promoters are known in the art (see, e.g., Castiglione et al., 2009; Eiglmeier et al., 1989; Galimand et al., 1991; Hasegawa et al., 1998; Hoeren et al., 1993; Salmon et al., 2003), and non-limiting examples are shown in Table 1.

In a non-limiting example, a promoter (PfnrS) was derived from the *E. coli* Nissle fumarate and nitrate reductase gene S (fnrS) that is known to be highly expressed under conditions of low or no environmental oxygen (Durand and Storz, 2010; Boysen et al, 2010). The PfnrS promoter is activated under anaerobic conditions by the global transcriptional regulator FNR that is naturally found in Nissle. Under anaerobic conditions, FNR forms a dimer and binds to specific sequences in the promoters of specific genes under its control, thereby activating their expression. However, under aerobic conditions, oxygen reacts with iron-sulfur clusters in FNR dimers and converts them to an inactive form. In this way, the PfnrS inducible promoter is adopted to modulate the expression of proteins or RNA. PfnrS is used interchangeably in this application as FNRS, fnrs, FNR, P-FNRS promoter and other such related designations to indicate the promoter PfnrS.

TABLE 1

Examples of transcription factors and responsive genes and regulatory regions

| Transcription Factor | Examples of responsive genes, promoters, and/or regulatory regions: |
|---|---|
| FNR | nirB, ydfZ, pdhR, focA, ndH, hlyE, narK, narX, narG, yfiD, tdcD |
| ANR | arcDABC |
| DNR | norb, norC |

As used herein, a "non-native" nucleic acid sequence refers to a nucleic acid sequence not normally present in a microorganism, e.g., an extra copy of an endogenous sequence, or a heterologous sequence such as a sequence from a different species, strain, or substrain of bacteria or virus, or a sequence that is modified and/or mutated as compared to the unmodified sequence from bacteria or virus of the same subtype. In some embodiments, the non-native nucleic acid sequence is a synthetic, non-naturally occurring sequence (see, e.g., Purcell et al., 2013). The non-native nucleic acid sequence may be a regulatory region, a promoter, a gene, and/or one or more genes in gene cassette. In some embodiments, "non-native" refers to two or more nucleic acid sequences that are not found in the same relationship to each other in nature. The non-native nucleic acid sequence may be present on a plasmid or chromosome. In some embodiments, the genetically engineered bacteria of the disclosure comprise a gene that is operably linked to a directly or indirectly inducible promoter that is not associated with said gene in nature, e.g., an FNR-responsive promoter (or other promoter described herein) operably linked to a gene encoding an anti-cancer molecule. In some embodiments, the genetically engineered oncolytic virus of the disclosure comprise a gene that is operably linked to a directly or indirectly inducible promoter that is not associated with said gene in nature, e.g., a promoter operably linked to a gene encoding an anti-cancer molecule, such as any of the promoters described herein.

"Constitutive promoter" refers to a promoter that is capable of facilitating continuous transcription of a coding sequence or gene under its control and/or to which it is operably linked. Constitutive promoters and variants are well known in the art and include, but are not limited to, BBa_J23100, a constitutive *Escherichia coli* $\sigma^S$ promoter (e.g., an osmY promoter (International Genetically Engineered Machine (iGEM) Registry of Standard Biological Parts Name BBa_J45992; BBa_J45993)), a constitutive *Escherichia coli* $\sigma^{32}$ promoter (e.g., htpG heat shock promoter (BBa_J45504)), a constitutive *Escherichia coli* $\sigma^{70}$ promoter (e.g., lacq promoter (BBa_J54200; BBa_J56015), *E. coli* CreABCD phosphate sensing operon promoter (BBa_J64951), GlnRS promoter (BBa_K088007), lacZ promoter (BBa_K119000; BBa_K119001); M13K07 gene I promoter (BBa_M13101); M13K07 gene II promoter (BBa_M13102), M13K07 gene III promoter (BBa_M13103), M13K07 gene IV promoter (BBa_M13104), M13K07 gene V promoter (BBa_M13105), M13K07 gene VI promoter (BBa_M13106), M13K07 gene VIII promoter (BBa_M13108), M13110 (BBa_M13110)), a constitutive *Bacillus subtilis* $\sigma^A$ promoter (e.g., promoter veg (BBa_K143013), promoter 43 (BBa_K143013), $P_{liaG}$ (BBa_K823000), $P_{lepA}$ (BBa_K823002), $P_{veg}$ (BBa_K823003)), a constitutive *Bacillus subtilis* $\sigma^B$ promoter (e.g., promoter ctc (BBa_K143010), promoter gsiB (BBa_K143011)), a *Salmonella* promoter (e.g., Pspv2 from *Salmonella* (BBa_K112706), Pspv from *Salmonella* (BBa_K112707)), a bacteriophage T7 promoter (e.g., T7 promoter (BBa_I712074; BBa_I719005; BBa_J34814; BBa_J64997; BBa_K113010; BBa_K113011; BBa_K113012; BBa_R0085; BBa_R0180; BBa_R0181; BBa_R0182; BBa_R0183; BBa_Z0251; BBa_Z0252; BBa_Z0253)), and a bacteriophage SP6 promoter (e.g., SP6 promoter (BBa_J64998)). In some embodiments, such promoters are active in vitro, e.g., under culture, expantion and/or manufacture conditions. In some embodiments, such promoters are acitv in vivo, e.g., inconditions found in the in vivo environment, e.g., the gut and/or the tumor micorenvironment.

As used herein, "stably maintained" or "stable" bacterium or virus is used to refer to a bacterial or viral host cell carrying non-native genetic material, e.g., an anti-cancer molecule, such that the non-native genetic material is retained, expressed, and propagated. The stable bacterium or virus is capable of survival and/or growth in vitro, e.g., in medium, and/or in vivo, e.g., in hypoxic and/or necrotic tissues. For example, the stable bacterium or virus may be a genetically engineered bacterium or genetically engineered virus comprising non-native genetic material encoding an anti-cancer molecule, in which the plasmid or chromosome carrying the non-native genetic material is stably maintained in the bacterium or virus, such that the anti-cancer molecule can be expressed in the bacterium or virus, and the bacterium or virus is capable of survival and/or growth in vitro and/or in vivo.

As used herein, the terms "modulate" and "treat" and their cognates refer to an amelioration of a cancer, or at least one discernible symptom thereof. In another embodiment, "modulate" and "treat" refer to an amelioration of at least one measurable physical parameter, not necessarily discernible by the patient. In another embodiment, "modulate" and "treat" refer to inhibiting the progression of a cancer, either physically (e.g., stabilization of a discernible symptom), physiologically (e.g., stabilization of a physical parameter), or both. In another embodiment, "modulate" and "treat" refer to slowing the progression or reversing the progression of a cancer. As used herein, "prevent" and its cognates refer to delaying the onset or reducing the risk of acquiring a given cancer.

Those in need of treatment may include individuals already having a particular cancer, as well as those at risk of having, or who may ultimately acquire the cancer. The need for treatment is assessed, for example, by the presence of one or more risk factors associated with the development of a cancer (e.g., alcohol use, tobacco use, obesity, excessive exposure to ultraviolet radiation, high levels of estrogen, family history, genetic susceptibility), the presence or progression of a cancer, or likely receptiveness to treatment of a subject having the cancer. Cancer is caused by genomic instability and high mutation rates within affected cells. Treating cancer may encompass eliminating symptoms associated with the cancer and/or modulating the growth and/or volume of a subject's tumor, and does not necessarily encompass the elimination of the underlying cause of the cancer, e.g., an underlying genetic predisposition.

As used herein, the term "conventional cancer treatment" or "conventional cancer therapy" refers to treatment or therapy that is widely accepted and used by most healthcare professionals. It is different from alternative or complementary therapies, which are not as widely used. Examples of conventional treatment for cancer include surgery, chemotherapy, targeted therapies, radiation therapy, tomotherapy, immunotherapy, cancer vaccines, hormone therapy, hyperthermia, stem cell transplant (peripheral blood, bone marrow, and cord blood transplants), photodynamic therapy, therapy, and blood product donation and transfusion.

As used herein a "pharmaceutical composition" refers to a preparation of genetically engineered microorganism of the disclosure with other components such as a physiologically suitable carrier and/or excipient.

The phrases "physiologically acceptable carrier" and "pharmaceutically acceptable carrier" which may be used interchangeably refer to a carrier or a diluent that does not cause significant irritation to an organism and does not abrogate the biological activity and properties of the administered bacterial or viral compound. An adjuvant is included under these phrases.

The term "excipient" refers to an inert substance added to a pharmaceutical composition to further facilitate administration of an active ingredient. Examples include, but are not limited to, calcium bicarbonate, calcium phosphate, various sugars and types of starch, cellulose derivatives, gelatin, vegetable oils, polyethylene glycols, and surfactants, including, for example, polysorbate 20.

The terms "therapeutically effective dose" and "therapeutically effective amount" are used to refer to an amount of a compound that results in prevention, delay of onset of symptoms, or amelioration of symptoms of a condition, e.g., a cancer. A therapeutically effective amount may, for example, be sufficient to treat, prevent, reduce the severity, delay the onset, and/or reduce the risk of occurrence of one or more symptoms of a disorder associated with cancerous cells. A therapeutically effective amount, as well as a therapeutically effective frequency of administration, can be determined by methods known in the art and discussed below.

The articles "a" and "an," as used herein, should be understood to mean "at least one," unless clearly indicated to the contrary.

The phrase "and/or," when used between elements in a list, is intended to mean either (1) that only a single listed element is present, or (2) that more than one element of the list is present. For example, "A, B, and/or C" indicates that the selection may be A alone; B alone; C alone; A and B; A and C; B and C; or A, B, and C. The phrase "and/or" may be used interchangeably with "at least one of" or "one or more of" the elements in a list.

Bacteria

The genetically engineered microorganism, or programmed microorganisms, such as genetically engineered bacterium of the disclosure is capable of local and tumor-specific delivery of anti-cancer molecules, thereby reducing the systemic cytotoxicity and/or immune dysfunction associated with systemic administration of said molecules. The engineered bacteria may be administered systemically, orally, locally and/or intratumorally. In some embodiments, the genetically engineered bacteria are capable of targeting cancerous cells, particularly in the hypoxic regions of a tumor, and producing an anti-cancer molecule, e.g., an immune checkpoint inhibitor or other anti-cancer molecule provided herein. In some embodiments, the genetically engineered bacterium is a tumor-targeting bacterium that expresses an anti-cancer molecule under the control of a promoter that is activated by low-oxygen conditions, e.g., the hypoxic environment of a tumor.

In some embodiments, the tumor-targeting microorganism is a bacterium that is naturally capable of directing itself to cancerous cells, necrotic tissues, and/or hypoxic tissues. For example, bacterial colonization of tumors may be achieved without any specific genetic modifications in the bacteria or in the host (Yu et al., 2008). In some embodiments, the tumor-targeting bacterium is a bacterium that is not naturally capable of directing itself to cancerous cells, necrotic tissues, and/or hypoxic tissues, but is genetically engineered to do so. In some embodiments, the genetically engineered bacteria spread hematogenously to reach the targeted tumor(s). Bacterial infection has been linked to tumor regression (Hall, 1998; Nauts and McLaren, 1990), and certain bacterial species have been shown to localize to and lyse necrotic mammalian tumors (Jain and Forbes, 2001). Non-limiting examples of tumor-targeting bacteria are shown in Table 2.

TABLE 2

Bacteria with tumor-targeting capability

| Bacterial Strain | See, e.g., |
|---|---|
| Clostridium novyi-NT | Forbes, Neil S. "Profile of a bacterial tumor killer." Nature biotechnology 24.12 (2006): 1484-1485. |
| Bifidobacterium spp<br>Streptococcus spp<br>Caulobacter spp<br>Clostridium spp | Liu, Sai, et al. "Tumor-targeting bacterial therapy: A potential treatment for oral cancer." Oncology letters 8.6 (2014): 2359-2366. |
| Escherichia coli MG1655<br>Escherichia coli Nissle<br>Bifidobacterium breve UCC2003<br>Salmonella typhimurium | Cronin, Michelle, et al. "High resolution in vivo bioluminescent imaging for the study of bacterial tumour targeting." PloS one 7.1 (2012): e30940.; Zhou, et al., Med Hypotheses. 2011 April; 76(4): 533-4. doi: 10.1016/j.mehy.2010.12.010. Epub 2011 Jan. 21; Zhang et al., Appl Environ Microbiol. 2012 November; 78(21): 7603-7610; Danino et al., ScienceTranslationalMedicine, 2015 Vol 7 Issue 289, pp. 289ra84 |
| Clostridium novyi-NT<br>Bifidobacterium spp<br>Mycobacterium bovis<br>Listeria monocytogenes<br>Escherichia coli<br>Salmonella spp<br>Salmonella typhimurium | Bernardes, Nuno, Ananda M. Chakrabarty, and Arsenio M. Fialho. "Engineering of bacterial strains and their products for cancer therapy." Applied microbiology and biotechnology 97.12 (2013): 5189-5199. |
| Salmonella choleraesuis<br>Vibrio cholera<br>Listeria monocytogenes<br>Escherichia coli<br>Bifidobacterium adolescentis<br>Clostridium acetobutylicum<br>Salmonella typhimurium<br>Clostridium histolyticum | Patyar, S., et al. "Bacteria in cancer therapy: a novel experimental strategy." J Biomed Sci 17.1 (2010): 21-30. |
| Escherichia coli Nissle 1917 | Danino et al. "Programmable probiotics for detection of cancer in urine." Sci Transl Med. 2015 May 27; 7(289): 289ra84 |

The tumor-targeting capability of certain bacteria appears to be dependent on the stage of tumor development, but independent of tumor type (Yu et al., 2008). Intravenously injected bacteria have been shown to target the central portion of tumors and coincide with the necrotic regions of those tumors (Yu et al., 2008). Inflammation alone has been shown to be insufficient to sustain bacterial colonization (Yu et al., 2008). In some embodiments, tumors are sensitized, e.g., by oncolytic vaccinia virus, prior to bacterial delivery to enhance colonization. In some embodiments, the blood-borne bacteria enter tumors and are able to amplify in the central necrotic region because clearance of bacteria is inhibited (Yu et al., 2008).

In some embodiments, the gene of interest is expressed in a bacterium which enhances the efficacy of immunotherapy. Vetizou et al (2015) describe T cell responses specific for *Bacteroides thetaiotaomicron* or *Bacteroides fragilis* that were associated with the efficacy of CTLA-4 blockade in mice and in patients. Sivan et al. (2015) illustrate the importance of *Bifidobacterium* to antitumor immunity and anti-PD-L1 antibody against (PD-1 ligand) efficacy in a mouse model of melanoma. In some embodiments, the bacteria expressing the one or more anti-cancer molecules are *Bacteroides*. In some embodiments, the bacteria expressing the one or more anticancer molecules are *Bifidobacterium*. In some embodiments, the bacteria expressing the one or more anticancer molecules are *Escherichia Coli* Nissle. In some embodiments, the bacteria expressing the one or more anticancer molecules are *Clostridium novyi*-NT. In some embodiments, the bacteria expressing the one or more anticancer molecules are *Clostridium butyricum miyairi*.

In certain embodiments, the genetically engineered bacteria are obligate anaerobic bacteria. In certain embodiments, the genetically engineered bacteria are facultative anaerobic bacteria. In certain embodiments, the genetically engineered bacteria are aerobic bacteria. In some embodiments, the genetically engineered bacteria are Gram-positive bacteria and lack LPS. In some embodiments, the genetically engineered bacteria are Gram-negative bacteria. In some embodiments, the genetically engineered bacteria are Gram-positive and obligate anaerobic bacteria. In some embodiments, the genetically engineered bacteria are Gram-positive and facultative anaerobic bacteria. In some embodiments, the genetically engineered bacteria are non-pathogenic bacteria. In some embodiments, the genetically engineered bacteria are commensal bacteria. In some embodiments, the genetically engineered bacteria are probiotic bacteria. In some embodiments, the genetically engineered bacteria are naturally pathogenic bacteria that are modified or mutated to reduce or eliminate pathogenicity. Exemplary bacteria include, but are not limited to, *Bacillus, Bacteroides, Bifidobacterium, Brevibacteria, Caulobacter, Clostridium, Enterococcus, Escherichia coli, Lactobacillus, Lactococcus, Listeria, Mycobacterium, Saccharomyces, Salmonella, Staphylococcus, Streptococcus, Vibrio, Bacillus coagulans, Bacillus subtilis, Bacteroides fragilis, Bacteroides subtilis, Bacteroides thetaiotaomicron, Bifidobacterium adolescentis, Bifidobacterium bifidum, Bifidobacterium breve* UCC2003, *Bifidobacterium infantis, Bifidobacterium lactis, Bifidobacterium longum, Clostridium acetobutylicum, Clostridium butyricum, Clostridium butyricum* M-55, *Clostridium butyricum miyairi, Clostridium cochlearum, Clostridium felsineum, Clostridium histolyticum, Clostridium multifermentans, Clostridium novyi*-NT, *Clostridium paraputrificum, Clostridium pasteureanum, Clostridium pectinovorum, Clostridium perfringens, Clostridium roseum, Clostridium sporogenes, Clostridium tertium, Clostridium tetani, Clostridium tyrobutyricum, Corynebacterium parvum, Escherichia coli* MG1655, *Escherichia coli* Nissle 1917, *Listeria monocytogenes, Mycobacterium bovis, Salmonella choleraesuis, Salmonella typhimurium, Vibrio cholera*, and the bacteria shown in Table 2. In certain embodiments, the genetically engineered bacteria are selected from the group consisting of *Enterococcus faecium, Lactobacillus acidophilus, Lactobacillus bulgaricus, Lactobacillus casei, Lactobacillus johnsonii, Lactobacillus paracasei, Lactobacillus plantarum, Lactobacillus reuteri, Lactobacillus rhamnosus, Lactococcus lactis*, and *Saccharomyces boulardii*. In certain embodiments, the genetically engineered bacteria are selected from the group consisting of *Bacteroides fragilis, Bacteroides thetaiotaomicron, Bacteroides subtilis, Bifidobacterium bifidum, Bifidobacterium infantis, Bifidobacterium lactis, Clostridium butyricum, Escherichia coli* Nissle, *Lactobacillus acidophilus, Lactobacillus plantarum, Lactobacillus reuteri*, and *Lactococcus lactis*. In some embodiments, *Lactobacillus* is used for tumor-specific delivery of one or more anti-cancer molecules. *Lactobacillus casei* injected intravenously has been found to accumulate in tumors, which was enhanced through nitroglycerin (NG), a commonly used NO donor, likely due to the role of NO in increasing the blood flow to hypovascular tumors (Fang et al, 2016 (Methods Mol Biol. 2016; 1409:9-23. Enhancement of Tumor-Targeted Delivery of Bacteria with Nitroglycerin Involving Augmentation of the EPR Effect).

In some embodiments, the genetically engineered bacteria are obligate anaerobes. In some embodiments, the genetically engineered bacteria are Clostridia and capable of tumor-specific delivery of anti-cancer molecules. Clostridia are obligate anaerobic bacterium that produce spores and are naturally capable of colonizing and in some cases lysing hypoxic tumors (Groot et al., 2007). In experimental models, Clostridia have been used to deliver pro-drug converting enzymes and enhance radiotherapy (Groot et al., 2007). In some embodiments, the genetically engineered bacteria is selected from the group consisting of *Clostridium novyi*-NT, *Clostridium histolyticium, Clostridium tetani, Clostridium oncolyticum, Clostridium sporogenes*, and *Clostridium beijerinckii* (Liu et al., 2014). In some embodiments, the *Clostridium* is naturally non-pathogenic. For example, *Clostridium oncolyticum* is apathogenic and capable of lysing tumor cells. In alternate embodiments, the *Clostridium* is naturally pathogenic but modified to reduce or eliminate pathogenicity. For example, *Clostridium novyi* are naturally pathogenic, and *Clostridium novyi*-NT are modified to remove lethal toxins. *Clostridium novyi*-NT and *Clostridium sporogenes* have been used to deliver single-chain HIF-1α antibodies to treat cancer and is an "excellent tumor colonizing *Clostridium* strains" (Groot et al., 2007).

In some embodiments, the genetically engineered bacteria facultative anaerobes. In some embodiments, the genetically engineered bacteria are *Salmonella*, e.g., *Salmonella typhimurium*, and are capable of tumor-specific delivery of anti-cancer molecules. *Salmonella* are non-spore-forming Gram-negative bacteria that are facultative anaerobes. In some embodiments, the *Salmonella* are naturally pathogenic but modified to reduce or eliminate pathogenicity. For example, *Salmonella typhimurium* is modified to remove pathogenic sites (attenuated). In some embodiments, the genetically engineered bacteria are *Bifidobacterium* and capable of tumor-specific delivery of anti-cancer molecules. *Bifidobacterium* are Gram-positive, branched anaerobic bacteria. In some embodiments, the *Bifidobacterium* is naturally non-pathogenic. In alternate embodiments, the *Bifidobacterium* is naturally pathogenic but modified to reduce or eliminate pathogenicity. *Bifidobacterium* and *Salmonella* have been shown to preferentially target and replicate in the hypoxic and necrotic regions of tumors (Yu et al., 2014).

In some embodiments, the genetically engineered bacteria are Gram-negative bacteria. In some embodiments, the genetically engineered bacteria are *E. coli*. For example, *E. coli* Nissle has been shown to preferentially colonize tumor tissue in vivo following either oral or intravenous administration (Zhang et al., 2012 and Danino et al., 2015). *E. coli* have also been shown to exhibit robust tumor-specific replication (Yu et al., 2008). In some embodiments, the genetically engineered bacteria are *Escherichia coli* strain Nissle 1917 (*E. coli* Nissle), a Gram-negative bacterium of the Enterobacteriaceae family that "has evolved into one of the best characterized probiotics" (Ukena et al., 2007). The strain is characterized by its complete harmlessness (Schultz, 2008), and has GRAS (generally recognized as safe) status (Reister et al., 2014, emphasis added).

The genetically engineered bacteria of the invention may be destroyed, e.g., by defense factors in tissues or blood serum (Sonnenborn et al., 2009). In some embodiments, the genetically engineered bacteria are administered repeatedly. In some embodiments, the genetically engineered bacteria are administered once.

In certain embodiments, the anti-cancer molecule (s) described herein are expressed in one species, strain, or subtype of genetically engineered bacteria. In alternate embodiments, the anti-cancer molecule is expressed in two or more species, strains, and/or subtypes of genetically engineered bacteria. One of ordinary skill in the art would appreciate that the genetic modifications disclosed herein may be modified and adapted for other species, strains, and subtypes of bacteria.

Further examples of bacteria which are suitable are described in International Patent Publication WO/2014/043593, the contents of which is herein incorporated by reference in its entirety. In some embodiments, such bacteria are mutated to attenuate one or more virulence factors.

In some aspects, the engineered bacteria can be combined with other cancer therapies, e.g., conventional anti-cancer therapies, other immunotherapies, and/or engineered or unengineered oncolytic viruses (such as described herein).

Oncolytic Viruses

The genetically engineered oncolytic virus of the disclosure is capable of local and tumor-specific delivery of anti-cancer molecules, thereby reducing the systemic cytotoxicity and/or immune dysfunction associated with systemic administration of said molecules. An oncolytic virus (OV) is a virus, which can specifically infect and lyse cancer cells, and leave non-cancer cells intact. Thus, oncolytic viruses are able to selectively replicate in cancer cells and can also spread within a tumor without causing damage to normal tissue. In addition to having direct oncolytic activity, OVs are very effective at inducing immune responses to themselves and to the infected cancer cells. OVs can act as in situ vaccines and can also be engineered to produce one or more anti-cancer molecules, (e.g., express one or more immunomodulatory transgenes). Thus, OVs can be armed with therapeutic trans-genes, combining local gene delivery with oncolytic activity. Local expression in the tumor obviated toxicity arising from systemic administration of potent immune modulators. In some aspects, the OVs can be combined with other cancer therapies, e.g., conventional anti-cancer therapies, other immunotherapies, and/or engineered bacteria (such as described herein).

OVs encompass a broad diversity of DNA and RNA viruses that are naturally cancer selective or can be genetically engineered to target cancer cells. Viruses that naturally replicate preferentially in cancer cells and are non-pathogenic in human typically have heightened sensitivity to innate antiviral signaling or depend on oncogenic signally pathways. Such OVs include, but are not limited to, autonomous Parvovirus, myxoma virus (MYXV, pox virus), Newcastle disease virus (NDV, paramyxovirus), reovirus, and Seneca valley virus (picornavirus). Viruses that are genetically manipulated for use as vaccine vectors include, but are not limited to, measles virus (MV, paramyxovirus), poliovirus (PV, picornavirus), and vaccinia virus (VV, poxvirus). Viruses that are genetically modified to have mutations or deletions in genes required for replication in normal but not in cancer cells, include, but are not limited to, adenovirus (Ad), herpes simplex virus (HSV), VV, vesicular stomatitis virus (VSV, rhabdovirus). Other exemplary OVs include Rabies, west nile virus, Coxsackie, fowlpox, fowlpox/vaccinia and derivatives or modified viruses thereof.

A broad range of potentially pathogenic viruses can be genetically engineered for safety and targeting. Many of the natural properties and characteristics of cancer cells provide a permissive environment for OVs, including sustained proliferation, resisting ell death, evading growth suppressors, genomic instability, DNA damage stress, and avoiding immune destruction. In addition, oncolytic viruses can be genetically engineered to exploit tumor-specific attributes or defects in gene expression to achieve tumor-specificity through a number of different strategies (Turnbull et al., Viruses (7): 6291-6321. Evidence for Oncolytic Virotherapy: Where have we got to and where are we going?). For example, insertion of foreign sequences or deletion of native viral sequences can provide further selectivity for cancer cells and improve safety, as well as alter virus tropism through the targeting of translation with internal ribosome entry sites (IRES) or microRNAs (PV and VSV), transcription with cell-specific promoters/enhancers, or transduction with altered virus receptors.

Oncolytic viruses offer several features that make them advantageous, including a low probability for the generation of resistance, they replicate in a tumor-selective fashion, they are relatively non-pathogenic, virus dose in the tumor increases over time as the virus amplifies, and safety features can be built in, such as drug and immune sensitivity. Also, many OVs act as in situ vaccines, inducing robust, long-lasting, and specific adaptive anti-tumor responses, often CD8+ Tcell mediated. OVs expressing tumor-associated antigens, TAAs, can be used to induce tumor-selective adaptive immune responses. Following oncolytic cell death tumor cells release tumor-associated antigens that serve to promote adaptive immune response that mediates tumor regression at distant tumor sites that are not exposed to virus. They also release viral PAMPa and DAMPs and cytokines that promote the maturation of antigen-presenting cells, such as dendritic cells. These activate antigen-specific CD4+ and CD8+ T cell responses. Once activated CD8+ Tcells can expand into cytotoxic effector cells with the ability to traffic to sites of established tumor growth, where they mediate anti-tumor immunity upon antigen recognition. The combination of TAA expression in the tumor and OV-mediated cell killing induces enhanced Tcell migration and activation compared with OV-infected tumor cells expressing the TAA.

Cell carriers, e.g., mesenchymal stromal cells, myeloid-derived suppressor cells, neural stem cells, T cells, cytokine-induced killer cells, can shield virus from neutralization and facilitate delivery to the tumor. In addition, many OVs express immune evasion genes that enable them to establish infections and spread within their host. Moreover, while cancer cells have established sophisticated strategies for avoiding immune-mediated destruction, oncolytic viruses can modify this suppressive microenvironment through a variety of mechanisms that alter the cytokine milieu and the type of immune cells within the tumor microenvironment. These changes promote immune-mediated tumor cell recognistion and eradication, and can trigger TAA and epitope spreading.

Antitumor effects of OVs occur through multiple mechanisms. Viral replication and lysis reduces the size of the tumor, but also exposes tumor associated antigens and neoantigens to antigen presenting cells, leading to immune-mediated antitumor responses. The killing of cancer cells can result in the release of novel cancer antigens (neoantigens) that may have been previously hidden to the immune system due to restricted presentation. Such neoantigens can be taken up by local APCs in the context of a pro-inflammatory environment, which can trigger an immune response against the neo-antigen, killing the antigen-expressing cancer cells (including those cancer cells not infected by the virus). In addition to direct tumor cell lysis, OV infection causes cytokine and chemokine secretion. These cytokines and chemokines can both directly kill cancer cells and engage and activate innate and adaptive cells to fight the tumor. The extent to which each mechanism contributes to anti-tumor activity varies by species and strain.

Most OVs have a natural tropism for cell surface proteins that are aberrantly expressed by cancer cells. For example, HSV-1 uses the herpes virus entry mediator (HVEM) and selected nectins, which are expressed on melanoma and carcinoma cells, for cell entry. Measles virus uses CD46 receptor, which is overexpressed on cancer cells for cell entry. Coxsackie virus can enter cells vis ICAM (CD55) which is overexpressed on multiple myeloma, melanoma, and breast cancer cells. OVs can also be engineered to target unique cell surface receptors expressed by a specific type of cancer cell. One strategy used to make OVs tumor-specific involves the targeting of the interferon pathways, as is employed by VSV. Type I interferon (IFN) is produced and secreted as a response to viral infection, resulting in inhibition of protein synthesis in adjacent cells and thereby preventing infection of these cells. Most cancer cells exhibit defective IFN signaling, so tumor specificity can be enhanced by altering OVs to induce a more potent IFN response, thereby minimizing the replication of such viruses in normal cells but not cancer cells.

OVs can be made tumor-specific through the placement of an essential viral gene under the regulation of tumor-specific promoter (such as PSA for prostate). OVs can be targeted to the hypoxic microenvironment through the use of a hypoxia inducible promoter to drive the expression of an essential gene. In addition, in some embodiments the OVs may genetically engineered to express a protein of interest, driven by a hypoxic promoter. Such hypoxic promoters include but are not limited to, promoters, which include a hypoxia response element (HRE). In addition, the presence of high levels of tumor-specific receptors, such as MV and CD46, can be used for targeting of oncolytic viruses specifically to cancer cells.

OVs can also be engineered to express suicide genes (genes that render cells more sensitive to apoptosis or other drug therapy) which enhance their lytic activity and their ability to directly kill cancer cells. For example, TNF-α and TNF-related apoptosis inducing ligand (TRAIL) have been introduced into viruses to enhance cell death and trigger an immune response.

HSV-1 is a double-stranded DNA virus with a large genome (152 KB) in which 30 KB encode genes not essential for viral infection. To make it tumor selective and to reduce its pathogenicity, HSV-1 is modified through removal of the ICP34.5 gene product. ICP34.5 inhibits activation of PKR, preventing the inhibition of viral translation. Cancer cells are resistant to the PKR activated inhibition of viral replication due to the high level of Ras activity, which prevents activation of PKR, allowing the OV to multiply in tumor cells, while replication is prevented in normal cells. Tumor specificity of HSV-1 is further improved through the move of the US11 gene under the immediate early promoter. Immediate early expression of US11 enhances replication of ICP34.5-deficient HSV-1 strains in tumors. When expressed transiently as an immediate early gene, US11 rescues the growth defect associated with ICP34.5 deletion by inhibiting PKR before shutdown of protein synthesis, but does not reestablish replication in normal cells. As an alternative strategy, improvement of tumor specificity can also be achieved by a second mutation in the UL39 gene in combination with mutation of ICP34.5. UL39 encodes the large subunit of the viral ribonucleotide reductase (ICP6). Therefore, proliferation of these viruses is facilitated in cancer cells, which express large amounts of endogenous ribonucleotide reductase, and not normal cells, which express low levels of the enzyme. HSV-1 is also modified to delete ICP47 which results in the presentation of viral antigens to selectively propagate oncolytic HSV-1 and to induce the early activation of the US11 promoter.

Adenovirus is non-enveloped double-stranded DNA virus with a linear genome of about 35 KB encapsulated with an isosahedral capsid and is asymptomatic in immune-competent hosts. The adenovirus genome is relatively easy to modify and transgenes of about 10 KB can be inserted without disrupting viral infection. Adenovirus enters the cell using the CAR receptor. Adenoviral tumor specificity can be achieved through targeting the dysregulation of apoptosis in cancer cells. Adenoviral E1A and E1B inactivate tumor suppressors pRb and p53 in normal cells, thereby preventing apoptosis. A virus harboring a deletion in E1 can be rendered tumor specific, as these tumor suppressors are not expressed in certain tumors. For example, ONYX-15 is a human adenovirus genetically modified with mutated E1B and HB101 with deletions in E1B and E3. The adenovirus can be modified to incorporate an RGD motif, which targets it to ovarian cancer cells. Several modified adenoviruses are currently in clinical trials. For example, adenoviral constructs with tumor specific lytic activity under clinical development include transgenic Oncolytic Adenovirus Expressing IL-12 (Ziopharm), IT AdGVEGR.TNF.11D (Transgenic Oncolytic Adenovirus expressing TNF; GenVec National Institutes of Health (NIH)), and AdCD40L (Transgenic Oncolytic Adenovirus expressing CD40L; Uppsala University).

Vaccinia virus is a member of the poxvirus family and has a large dsDNA genome (about 190 KB). Vaccinia replicates entirely in the cytoplasm of infected cells and can infect a wide range of cells and is highly tropic for cancer cells. Vaccinia has been modified (attenuated) for use as a vaccine and an oncolytic agent. Specifically, viral TK, vaccinia growth factor, and vaccinia type I IFN-binding protein have been modified to increase cancer cell selectivity and lysis. Vaccinia virus has been engineered to exress tumor antigens (PSA, CEA, mucin 1), Tcell co-stimulatory molecules (B7-1, ICAM-1, LFA3), and inflammatory cytokines (GM-CSF).

Coxsackievirus is a non-enveloped single-stranded RNA enterovirus that is a member of the Picornavirus family. It replicates in the cytosol without a DNA phase. In addition to direct lysis of tumor cells, caxsackievirus has been shown to enhance the immune response by promoting the release of DAMPs. Coxsackievirus infection also promotes the infiltration of immune effector cell, including NK and CD8+ cells, and enhances antigen presentation by activating dendritic cells. It can also release type I IFN which may enhance an antitumor immune response.

Newcastle disease virus (NVD) is a single-stranded RNA enveloped avian paramyxovirus that ranges in size from 100 to 500 nm. NVD infects through the cells through plasma membrane fusion or direct endocytosis of the virus and replicates in the cytoplasm. NVD induces cancer cell apoptosis and directly activates the innate immune system through increased cytokine production (type I IFN, RANTES, IL-12, GM-CSF) and improved antigen presentation. The NVD-induced apoptosis of cancer cells results in the conversion of an immune-suppressive tumor microenvironment into a pro-inflammatory environment that supports anti-tumor immune responses. Although NVD has a relatively small genome, it can accommodate the insertion of foreign genes.

Measles virus is a negative-stranded RNA paramyxovirus with a genome of about 15 KB. Measles virus uses the SLAM receptor, which is expressed on lymphocytes and/or CD46 to enter cells. Measles virus can cause serious illness in humans and its pathology limits its use as an oncolytic therapeutic virus, although attenuated strains are currently being investigated.

Reovirus is a double-stranded, non-enveloped RNA virus with an outer capsid and an inner core. Viral proliferation occurs in the cytoplasm of infected cells. Reovirus preferentially targets RAS-mutant cancers, such as gliomas, melanomas, ovarian cancer, and colorectal cancer.

Poliovirus is a non-enveloped, single-stranded RNA picornavirus that enters cells by binding to CD155 and following internalization undergoes replication within the cytoplasm. Poliovirus must be attenuated as it is highly pathogenic in humans. To reduce neurovirulance, poliovirus can be further attenuated by replacing the viral internal ribosome entry site (IRES) with an IRES from the related human rhino virus type 2 (HRV2), which also enhances the selectivity for glioma cells and is currently in clinical trials for treatment of GBM.

Talimogene laherparepvec (T-VEC) (HSV-1 virus) has been approved for the treatment of melanoma in patients with inoperable tumors. T-VEC has multiple genetic modifications such that it replicates in tumor cells but not in normal cells. Tumor selectivity of T-VEC is achieved through the removal of the ICP34.5 gene product, and through the move of the US11 gene under the immediate early promoter, as described above. T-VEC further allows enhanced antigen processing and CD8+ T cell immunity through the removal of ICP47. Removal of ICP47 permits proper antigen processing (for both virus and tumor antigens), resulting in enhanced MHC class I presentation and consequently, the generation of a productive T cell adaptive immune response. Finally, the gene encoding hGM-CSF has been inserted in each of the two ICP34.5 regions in place of the deleted sequences. Local GM-CSF expression following intratumoral injection is intended to increase the influx and activation of antigen presenting cells, which process and present tumor-associated antigens derived from tumor cells and which prime tumor-specific CD4+ and CD8+ T cells to stimulate and generate a systemic and specific anti-tumor immune response. Of note, T-VEC remains susceptible to anti-herpes virus pro-drugs (eg, acyclovir, penciclovir, valacyclovir and famciclovir) through the presents of the viral thymidine kinase gene. In addition to T-VEC, other useful OVs include ONYX-015, JX-594, PROSTVAC-VF, CAV-ATAK, and derivatives thereof.

Anti-Cancer Molecules

Elimination (reversal) of Local Immune Suppression

Inappropriately dividing cells, such as cancer cells, activate immune responses, which begin with inflammation mediated by macrophages and their precursors, monocytes. Secreted cytokines, in turn, stimulate dendritic cells to mature and present antigens to T lymphocytes, initiating destruction of the nascent tumor. However, tumor cells often escape destruction by producing signals that interfere with antigen presentation or maturation of dendritic cells, causing their precursors to mature into immunosuppressive cell types instead. Once subverted in this way, inflammation can assist tumor growth by, for example, promoting angiogenesis and other factors that aid in the growth and maintenance of the tumor. Therefore, the local delivery of one or more anti-cancer molecules that prevent or inhibit the activities of immunomodulatory molecules involved in initiating, promoting and/or maintaining immunosuppression at the tumor site, alone or in combination with one or more other anti-cancer molecules, provides a therapeutic benefit.

Immune Checkpoint Inhibitors

In some embodiments, the anti-cancer molecule is an inhibitor of an immune suppressor molecule, for example, an inhibitor of an immune checkpoint molecule. The immune system is finely regulated to protect from invading pathogens, while avoiding immune responses mounted against the host's own cells. Immune checkpoint molecules help prevent the development of autoimmune diseases. Several cancer drugs aim to inhibit these checkpoints in order to activate the immune system and boost the patient's anti-tumor responses, thus allowing the immune system to mount immune responses against self-antigens on cancerous cells. However, altered immunoregulation can provoke immune dysfunction and lead to autoimmune disorders when administered systemically. The problem of immune dysfunction, e.g., the development of an undesired autoimmune response, can be addressed by delivering an immune checkpoint inhibitor or inhibitor of another immune suppressor molecule locally at the tumor site. In some embodiments, local delivery includes direct tumor administration, e.g., intratumoral delivery. The immune checkpoint molecule to be inhibited can be any known or later discovered immune checkpoint molecule or other immune suppressor molecule. In some embodiments, the immune checkpoint molecule, or other immune suppressor molecule, to be inhibited is selected from CTLA-4, PD-1, PD-L1, PD-L2, TIGIT, VISTA, LAG-3, TIM1, TIM3, CEACAM1, LAIR-1, HVEM, BTLA, CD160, CD200, CD200R, CD39, CD73, B7-H3, B7-H4, IDO, TDO, KIR, and A2aR. In certain aspects, the present disclosure provides an engineered microorganism, e.g., engineered bacteria or engineered oncolytic virus, that is engineered to produce one or more anti-cancer molecules that inhibit an immune checkpoint or other immune suppressor molecule. In some embodiments, the genetically engineered microorganisms are capable of reducing cancerous cell proliferation, tumor growth, and/or tumor volume. In some embodiments, the genetically engineered bacterium is a tumor-targeting bacterium. In some embodiments, the genetically engineered oncolytic virus is a tumor-targeting oncolytic virus or has been engineered to target a cancer or tumor cell. In some embodiments, the genetically engineered microorganism is a bacterium that expresses an immune checkpoint inhibitor, or inhibitor of another immune suppressor molecule, under the control of a promoter that is activated by low-oxygen conditions, e.g., the low-oxygen environment of a tumor. In some embodiments, the genetically engineered microorganism is an oncolytic virus that expresses an immune checkpoint inhibitor, or inhibitor of another immune suppressor molecule, under the control of a promoter that is activated by low-oxygen conditions, e.g., the low-oxygen environment of a tumor. In some embodiments, the genetically engineered bacterium or genetically engineered oncolytic virus express one or more immune checkpoint inhibitors, under the control of a promoter that is activated by hypoxic conditions or by inflammatory conditions, such as any of the promoters activated by said conditions and described herein. In some embodiments, the genetically engineered OV expresses one or more immune checkpoint inhibitors, under the control of a cancer-specific promoter, a tissue-specific promoter, or a constitutive promoter, such as any of the promoters described herein.

In some embodiments, the genetically engineered microorganisms of the disclosure are genetically engineered bacteria or genetically engineered oncolytic viruses comprising a gene encoding a CTLA-4 inhibitor, for example, an antibody directed against CTLA-4. In any of these embodiments, the anti-CTLA-4 antibody may be a single-chain anti-CTLA-4 antibody. In some embodiments, the genetically engineered microorganisms of the disclosure are genetically engineered bacteria or genetically engineered oncolytic viruses comprising a gene encoding a PD-1 inhibitor, for example, an antibody directed against PD-1. In any of these embodiments, the anti-PD-1 antibody may be a single-chain anti-PD-1 antibody. In some embodiments, the genetically engineered microorganisms of the disclosure are engineered bacteria or engineered oncolytic viruses comprising a gene encoding an inhibitor selected from PD-L1, PD-L2, TIGIT, VISTA, LAG-3, TIM1, TIM3, CEACAM1, LAIR-1, HVEM, BTLA, CD160, CD200, CD200R, CD39, CD73, B7-H3, B7-H4, IDO, TDO, KIR, and A2aR inhibitors, e.g., an antibody directed against any of the listed immune checkpoints or other suppressor molecules. In any of these embodiments, the antibody may be a single-chain antibody. In some embodiments, the engineered bacteria or engineered oncolytic virus expressing a checkpoint inhibitor, or inhibitor of another immune suppressor molecule, is administered locally, e.g., via intratumoral injection. In some embodiments, the engineered bacteria or engineered oncolytic virus expressing a checkpoint inhibitor, or inhibitor of another immune suppressor molecule, is a tumor-targeting bacterium or a tumor-targeting oncolytic virus. In some embodiments, the genetically engineered microorganisms of the disclosure are tumor-targeting bacteria or tumor-targeting oncolytic virus comprising a gene encoding a CTLA-4 inhibitor, e.g., an anti-CTLA-4 antibody, and are capable of delivering the anti-cancer molecule specifically and locally to cancerous cells. In some embodiments, the genetically engineered bacteria or genetically engineered oncolytic viruses of the disclosure are tumor-targeting bacteria or tumor-targeting oncolytic viruses comprising a gene encoding a PD-1 inhibitor, e.g., an anti-PD-1 antibody, and are capable of delivering the anti-cancer molecule specifically and locally to cancerous cells. In other embodiments, the genetically engineered bacteria or genetically engineered oncolytic viruses are tumor-targeting bacteria or tumor targeting oncolyutic viruses comprising a gene encoding an inhibitor of a checkpoint, or an inhibitor of another immune suppressor molecule, selected from PD-L1, PD-L2, TIGIT, VISTA, LAG-3, TIM1, TIM3, CEACAM1, LAIR-1, HVEM, BTLA, CD160, CD200, CD200R, CD39, CD73, B7-H3, B7-H4, IDO, TDO, KIR, and A2aR, e.g., an antibody against any of such molecules and are capable of delivering the anti-cancer molecule specifically and locally to cancerous cells.

In other embodiments, the genetically engineered bacteria or genetically engineered oncolytic viruses of the disclosure comprise one or more genes encoding one or more inhibitors of an immune checkpoint or other immune suppressor molecule, selected from CTLA-4, PD-1, PD-L1, PD-L2, TIGIT, VISTA, LAG-3, TIM1, TIM3, CEACAM1, LAIR-1, HVEM, BTLA, CD160, CD200, CD200R, CD39, CD73, B7-H3, B7-H4, IDO, TDO, KIR, and A2aR. The genetically engineered bacteria or genetically engineered oncolytic viruses can be delivered locally, e.g., via intratumoral injection or can be tumor targeting bacteria or oncolytic viruses that are delivered systemically and home to the targeted tumor.

Tumors use multiple mechanisms to evade immune surveillance and prevent attack by antigen-specific T cells. One such mechanism is the negative regulation of T cell activation. Co-inhibitory receptors play an important role in limiting the activation of T cells, and defects in their function result in abnormal immune responses, e.g., autoimmunity. Antibodies designed to block the interaction between different co-inhibitory receptors expressed on T cells and their respective ligands are currently being optimized as a form of anti-cancer immunotherapy. Antibodies targeting checkpoint proteins, such as cytotoxic T-lymphocyte associated protein 4 (CTLA-4) and programmed cell death protein 1 (PD-1), have been approved by the FDA for the treatment of cancer and have shown long-term responses in human patients.

In some embodiments, the disclosure provides a genetically engineered microorganism, e.g., engineered bacterium or engineered oncolytic virus, that expresses a CTLA-4 inhibitor. In some embodiments, the genetically engineered bacterium or engineered oncolytic virus expresses a CTLA-4 inhibitor under the control of a promoter that is activated by low-oxygen conditions, e.g., the hypoxic environment of a tumor. In some embodiments, the genetically engineered bacterium or genetically engineered oncolytic virus expresses an anti-CTLA-4 antibody, for example, a single chain antibody. In some embodiments, the genetically engineered bacterium or genetically engineered oncolytic virus is a tumor-targeting bacterium or tumor-targeting oncolytic virus that expresses an anti-CTLA-4 antibody, for example, a single chain antibody. In some embodiments, the genetically engineered bacterium or genetically engineered oncolytic virus expresses an anti-CTLA-4 antibody, for example, a single chain antibody, under the control of a promoter that is activated by low-oxygen conditions. In some embodiments, the genetically engineered bacterium or genetically engineered oncolytic virus is a tumor-targeting bacterium or tumor-targeting oncolytic virus that expresses an anti-CTLA-4 antibody, for example, a single chain antibody, under the control of a promoter that is activated by low-oxygen conditions.

In some embodiments, the genetically engineered bacterium or genetically engineered oncolytic virus expresses a CD-80 inhibitor. In some embodiments, the genetically engineered bacterium or genetically engineered oncolytic virus expresses an anti-CD80 antibody, e.g., single chain antibody. In some embodiments, the genetically engineered bacterium or genetically engineered oncolytic virus is a tumor-targeting bacterium or tumor-targeting oncolytic virus that expresses an anti-CD80 antibody, e.g., single chain antibody. In some embodiments, the genetically engineered bacterium or genetically engineered oncolytic virus expresses an anti-CD80 antibody, e.g., single chain antibody under the control of a promoter that is activated by low-oxygen conditions. In some embodiments, the genetically engineered bacterium or genetically engineered oncolytic virus is a tumor-targeting bacterium or tumor-targeting oncolytic virus that expresses an anti-CD80 antibody, e.g., single chain antibody under the control of a promoter that is activated by low-oxygen conditions.

In some embodiments, the genetically engineered bacterium or genetically engineered oncolytic virus expresses a CD-86 inhibitor. In some embodiments, the genetically engineered bacterium or genetically engineered oncolytic virus expresses an anti-CD86 antibody, e.g., single chain antibody. In some embodiments, the genetically engineered bacterium or genetically engineered oncolytic virus is a tumor-targeting bacterium or tumor-targeting oncolytic virus that expresses an anti-CD86 antibody, e.g., single chain antibody. In some embodiments, the genetically engineered bacterium or genetically engineered oncolytic virus expresses an anti-CD86 antibody, e.g., single chain antibody under the control of a promoter that is activated by low-oxygen conditions. In some embodiments, the genetically engineered bacterium or genetically engineered oncolytic virus is a tumor-targeting bacterium or tumor-targeting oncolytic virus that expresses an anti-CD86 antibody, e.g., single chain antibody under the control of a promoter that is activated by low-oxygen conditions.

In any of these embodiments, the anti-immune checkpoint antibody can be a single chain antibody. In any of these embodiments, the genetically engineered bacterium or genetically engineered oncolytic virus is a tumor-targeting bacterium or tumor-targeting oncolytic virus. In some embodiments, the genetically engineered bacterium or genetically engineered oncolytic virus express one or more single chain antibodies against one or more immune checkpoints, under the control of a promoter that is activated by low-oxygen conditions, by hypoxic conditions, or by inflammatory conditions, such as any of the promoters activated by said conditions and described herein. In some embodiments, the genetically engineered bacteria or genetically engineered OV expresses one or more single chain antibodies against one or more immune checkpoints, under the control of a cancer-specific promoter, a tissue-specific promoter, or a constitutive promoter, such as any of the promoters described herein.

Single-chain CTLA-4 antibodies have been shown to inhibit allogeneic T cell responses (Hwang et al., 2002). Surface-linked single-chain CTLA-4 antibodies have been shown to attenuate T cell responses (Griffin et al., 2000). CTLA-4 is a type I transmembrane glycoprotein of the immunoglobulin superfamily. The membrane-bound isoform of CTLA-4 functions as a homodimer linked by a disulfide bond, while the soluble isoform exists as a monomer. CTLA-4 is encoded by the human CTLA4 gene. Although the transcription factors controlling T cell expression of CTLA4 are not fully understood, nuclear factor for activated T cells (NFATc1) has been shown to bind to the CTLA4 promoter. Regulatory (suppressor) T cells constitutively express high levels of CTLA-4 on their surface, whereas expression of CTLA-4 is virtually undetectable in non-activated T cells (Perkins et al., 1996). Helper T cells, including CD4+ and CD8+ T cells, upregulate CTLA-4 expression only after they are activated (Walunas et al., 1994). Partial T cell activation occurs when an antigen-presenting cell (APC) engages with a T cell antigen receptor. Full activation requires the co-stimulatory T cell receptor, CD28, to bind its ligands, CD80 and CD86 (Rajani and Vile, 2015).

Upon activation, CTLA-4 interacts with the μ2 subunit of the clathrin adaptor protein complex, and translocates from intracellular vesicles to the plasma membrane with the help of GTPase ADP ribosylation factor-1 (Follows et al., 2001; Mead et al., 2005). However, since CTLA-4 is able to bind to CD80 and CD86 with higher affinity than to CD28, CTLA-4 expression acts as an "off" switch when bound to these ligands on the surface of antigen presenting cells (APCs), and prevents further CD28-mediated T cell activation (Śledzińska et al., 2015). CTLA-4 is also capable of inhibiting T cell responses via the SHP-2 and PP2A dephosphorylation of T cell receptor signaling proteins (e.g., CD3 and LAT), and limiting the conjugation time between T cells and APCs (Peggs et al., 2009; Riley et al., 2002).

In some embodiments, the genetically engineered microorganism is a tumor-targeting bacterium or a tumor-targeting oncolytic virus that expresses a PD-1 inhibitor. In some embodiments, the genetically engineered bacterium or genetically engineered oncolytic virus expresses a PD-1 inhibitor under the control of a promoter that is activated by low-oxygen conditions, e.g., the hypoxic environment of a tumor. In some embodiments, the genetically engineered microorganism is a tumor-targeting bacterium or a tumor-targeting oncolytic virus that expresses a PD-1 inhibitor under the control of a promoter that is activated by low-oxygen conditions, e.g., the hypoxic environment of a tumor. In some embodiments, the genetically engineered bacterium or genetically engineered oncolytic virus expresses an anti-PD-1 antibody, e.g., single chain antibody. In some embodiments, the genetically engineered bacterium or genetically engineered oncolytic virus is a tumor-targeting bacterium or tumor-targeting oncolytic virus that expresses an anti-PD-1 antibody, e.g., single chain antibody. In some embodiments, the genetically engineered bacterium or genetically engineered oncolytic virus expresses an anti-PD-1 antibody, e.g., single chain antibody, under the control of a promoter that is activated by low-oxygen conditions. In some embodiments, the genetically engineered bacterium or genetically engineered oncolytic virus is a tumor-targeting bacterium or tumor-targeting oncolytic virus that expresses an anti-PD-1 antibody, e.g., single chain antibody, under the control of a promoter that is activated by low-oxygen conditions.

In some embodiments, the genetically engineered bacterium or genetically engineered oncolytic virus expresses a PD-L1 inhibitor. In some embodiments, the genetically engineered bacterium or genetically engineered oncolytic virus expresses an anti-PD-L1 antibody, e.g., single chain antibody. In some embodiments, the genetically engineered bacterium or genetically engineered oncolytic virus is a tumor-targeting bacterium or tumor-targeting oncolytic virus that expresses an anti-PD-L1 antibody, e.g., single chain antibody. In some embodiments, the genetically engineered bacterium or genetically engineered oncolytic virus is a tumor-targeting bacterium or tumor-targeting oncolytic virus that expresses an anti-PD-L1 antibody, e.g., single chain antibody under the control of a promoter that is activated by low-oxygen conditions.

In some embodiments, the genetically engineered bacterium or genetically engineered oncolytic virus is a tumor-targeting bacterium or tumor-targeting oncolytic virus that expresses an PD-L2 inhibitor. In some embodiments, the genetically engineered bacterium or genetically engineered oncolytic virus is a tumor-targeting bacterium or tumor-targeting oncolytic virus that expresses an anti-PD-L2 antibody, e.g., single chain antibody. In some embodiments, the genetically engineered bacterium or genetically engineered oncolytic virus is a tumor-targeting bacterium or tumor-targeting oncolytic virus that expresses an anti-PD-L2 antibody, e.g., single chain antibody. In some embodiments, the genetically engineered bacterium or genetically engineered oncolytic virus is a tumor-targeting bacterium or tumor-targeting oncolytic virus that expresses an anti-PD-L2 antibody, e.g., single chain antibody under the control of a promoter that is activated by low-oxygen conditions.

In any of these embodiments, the anti-immune checkpoint antibody can be a single chain antibody. In any of these embodiments, the genetically engineered bacterium or genetically engineered oncolytic virus is a tumor-targeting bacterium or tumor-targeting oncolytic virus. In some embodiments, the genetically engineered bacterium or genetically engineered oncolytic virus express one or more single chain antibodies against one or more immune checkpoints, under the control of a promoter that is activated by low-oxygen conditions, by hypoxic conditions, or by inflammatory conditions, such as any of the promoters activated by said conditions and described herein. In some embodiments, the genetically engineered bacteria or genetically engineered OV expresses one or more single chain antibodies against one or more immune checkpoints, under the control of a cancer-specific promoter, a tissue-specific promoter, or a constitutive promoter, such as any of the promoters described herein.

PD-1 is a cell surface receptor of the immunoglobulin superfamily and contains an NFATc1 within its promoter region. PD-1 is highly expressed on activated T cells, pro-B cells, natural killer cells, and myeloid-derived cells. In addition to NFATc1, its expression may be induced by T cell receptor signaling, as well as gamma chain cytokines (e.g., interleukin (IL)-2, IL-7, IL-15, and IL-21)(Agata et al., 1996; Kinter et al., 2008). PD-1 is encoded by the human PDCD1 gene. PD-1 is a monomeric protein comprising an extracellular IgV-like domain, a transmembrane domain, and a cytoplasmic tail. The cytoplasmic tail contains two phosphorylation sites, located on an immunoreceptor tyrosine-based inhibitory motif and an immunoreceptor tyrosine-based switch motif, which allow PD-1 to negatively regulate T cell receptor signaling (Śledzińska et al., 2015). PD-1 inhibits immune responses by binding to its two known ligands, PD-L1 and PD-L2. Ligation triggers the upregulation of CBL-b and c-CBL E3-ubiquitin ligases, as well as the binding of SHP-2 and SHP-3 phosphatases to the cytoplasmic tail of PD-1. PD-1-ligand binding ultimately results in increased apoptosis in antigen-specific T cells, and reduced apoptosis in regulatory (suppressor) T cells.

PD-L1 (programmed cell death protein 1 ligand 1) is constitutively expressed at low levels and is upregulated upon activation on both hematopoietic cells (e.g., T, B, myeloid, and dendritic cells) and non-hematopoietic cells (e.g., lung, heart, and different types of cancer cells). PD-L1 can prevent anti-tumor immune responses by rendering tumor cells refractory to Fas ligation-induced apoptosis, and resistant to CD8+ T cell-mediated destruction. PD-L1 also acts by promoting the development and maintenance of regulatory T cells (Śledzińska et al., 2015). PD-L2 (programmed cell death protein 1 ligand 2; B7DC; CD273) is expressed by macrophages, dendritic cells, B-cell lymphomas, as well as certain types of solid tumors, including ovarian cancer, small cell lung cancer, and esophageal cancer. PD-L2 is predominantly expressed on T helper type 2 (Th2) cells, and is able to downregulate cytokine production and cellular proliferation via interactions with PD-1. Although the relative affinity of PD-L2 to PD-1 is two to six times higher than that of PD-L1, low-level expression of PD-L2 favors PD-L1 as the primary binding ligand of PD-1 (except for Th2 responses).

Lymphocyte-activation gene 3, or LAG-3 (CD223), is a immune checkpoint receptor with diverse biologic effects on T cell function. It is found on the cell surface of activated T cells, natural killer cells, B cells, plasmacytoid dendritic cells, and Tregs and has been reported to play a role in Treg suppressive function. LAG-3 is known to be involved in the maturation and activation of dendritic cells. LAG-3 binds to Class II MHC and and suppresses APC activation, as well as negatively regulates cellular proliferation, activation, and homeostasis of T cells, in a similar fashion to CTLA-4 and PD-1. LAG3 also helps maintain CD8$^+$ T cells in a tolerogenic state and, working with PD-1, helps maintain CD8+ Tcell exhaustion. Thus, in certain embodiments, the genetically engineered bacteria or genetically engineered oncolytic viruses produces an anti-cancer molecule that inhibits LAG3, for example, the genetically engineered microorganism may encode an antibody directed against LAG-3, e.g. a single-chain antibody against LAG-3. In some embodiments, the genetically engineered bacterium or genetically engineered oncolytic virus is a tumor-targeting bacterium or tumor-targeting oncolytic virus that expresses an anti-LAG-3 antibody, e.g., single chain antibody. In some embodiments, the genetically engineered bacterium or genetically engineered oncolytic virus expresses an anti-LAG-3 antibody, e.g., single chain antibody, under the control of a promoter that is activated by low-oxygen conditions. In some embodiments, the genetically engineered bacterium or genetically engineered oncolytic virus express an anti-LAG-3 antibody, e.g., single chain antibody, under the control of a promoter that is activated by hypoxic conditions, or by inflammatory conditions, such as any of the promoters activated by said conditions and described herein. In some embodiments, the genetically engineered bacteria or genetically engineered OV expresses an anti-LAG-3 antibody, e.g., single chain antibody, under the control of a cancer-specific promoter, a tissue-specific promoter, or a constitutive promoter, such as any of the promoters described herein.

TIGIT is expressed by subsets of regulatory and memory CD4+ T cells, CD8+ T cells, and natural killer cells. TIGIT modulates natural killer cell killing and CD4+ T cell activation and promotes tolerance by increasing interleukin 10 (IL-10) while suppressing IL-12 production by dendritic cells. Thus, in certain embodiments, the genetically engineered bacteria or genetically engineered oncolytic viruses produce an anti-cancer molecule that inhibits TIGIT, for example, the genetically engineered microorganism may encode an antibody directed against TIGIT, e.g. a single-chain antibody against TIGIT. In some embodiments, the genetically engineered bacterium or genetically engineered oncolytic virus is a tumor-targeting bacterium or tumor-targeting oncolytic virus that expresses an anti-TIGIT antibody, e.g., single chain antibody. In some embodiments, the genetically engineered bacterium or genetically engineered oncolytic virus expresses an anti-TIGIT antibody, e.g., single chain antibody, under the control of a promoter that is activated by low-oxygen conditions. In some embodiments, the genetically engineered bacterium or genetically engineered oncolytic virus is a tumor-targeting bacteria or tumor-targeting oncolytic virus that expresses an anti-TIGIT antibody, e.g., single chain antibody, under the control of a promoter that is activated by low-oxygen conditions. In some embodiments, the genetically engineered bacterium or genetically engineered oncolytic virus express an anti-TIGIT antibody, e.g., single chain antibody, under the control of a promoter that is activated by hypoxic conditions, or by inflammatory conditions, such as any of the promoters activated by said conditions and described herein. In some embodiments, the genetically engineered bacteria or genetically engineered OV expresses an anti-TIGIT antibody, e.g., single chain antibody, under the control of a cancer-specific promoter, a tissue-specific promoter, or a constitutive promoter, such as any of the promoters described herein.

V-domain immunoglobulin (Ig)-containing suppressor of T-cell activation (VISTA) is an immune checkpoint that is a potent negative regulator of T-cell function that is predominantly expressed on hematopoietic cells. VISTA is found at high levels on myeloid cells that infiltrated tumors in multiple murine cancer models. VISTA suppresses T-cell activation, induces Foxp3 expression, and is highly expressed within the tumor microenvironment. Its blockade can enhance antitumor immune responses in mice by improving T-cell responses, resulting in slowed tumor growth. Thus, in certain embodiments, the genetically engineered bacteria or genetically engineered oncolytic viruses produce an anti-cancer molecule that inhibits VISTA, for example, the genetically engineered microorganism may encode an antibody directed against VISTA, e.g. a single-chain antibody against VISTA. In some embodiments, the genetically engineered bacterium or genetically engineered oncolytic virus is a tumor-targeting bacterium or tumor-targeting oncolytic virus that expresses an anti-VISTA antibody, e.g., single chain antibody. In some embodiments, the genetically engineered bacterium or genetically engineered oncolytic virus expresses an anti-VISTA antibody, e.g., single chain antibody, under the control of a promoter that is activated by low-oxygen conditions. In some embodiments, the genetically engineered bacterium or genetically engineered oncolytic virus is a tumor-targeting bacteria or tumor-targeting oncolytic virus that expresses an anti-VISTA antibody, e.g., single chain antibody, under the control of a promoter that is activated by low-oxygen conditions. In some embodiments, the genetically engineered bacterium or genetically engineered oncolytic virus express an anti-VISTA antibody, e.g., single chain antibody, under the control of a promoter that is activated by hypoxic conditions, or by inflammatory conditions, such as any of the promoters activated by said conditions and described herein. In some embodiments, the genetically engineered bacteria or genetically engineered OV expresses an anti-VISTA antibody, e.g., single chain antibody, under the control of a cancer-specific promoter, a tissue-specific promoter, or a constitutive promoter, such as any of the promoters described herein.

B7-H3, or CD276, is an immune checkpoint molecule that belongs to the B7/CD28 superfamily. B7-H3 down-modulates human T-cell responses, e.g., decreases T cell proliferation and cytokine production in naïve as well as pre-activated T cells. B7-H3 expression has been reported in several human cancers, indicating a role for B7-H3 as a regulator of antitumor immunity. For example, Additionally, tumor B7-H3 expression is correlated with poor patient survival in a number of different tumor types, including in clear cell renal cell carcinoma, urothelial cell carcinoma, ovarian cancer, glioblastoma, osteosarcoma, pancreatic cancer, and neuroblastoma, as well as other solid tumors. The discovery of B7-H3 on tumor vasculature has further expanded its utility as a cancer immunotherapy target. Thus, in certain embodiments, the genetically engineered bacteria or genetically engineered oncolytic viruses produce an anti-cancer molecule that inhibits B7-H3, for example, the genetically engineered microorganism may encode an antibody directed against B7-H3, e.g. a single-chain antibody against B7-H3. In some embodiments, the genetically engineered bacterium or genetically engineered oncolytic virus is a tumor-targeting bacterium or tumor-targeting oncolytic virus that expresses an anti-B7-H3 antibody, e.g., single chain antibody. In some embodiments, the genetically engineered bacterium or genetically engineered oncolytic virus expresses an anti-B7-H3 antibody, e.g., single chain antibody, under the control of a promoter that is activated by low-oxygen conditions. In some embodiments, the genetically engineered bacterium or genetically engineered oncolytic virus is a tumor-targeting bacteria or tumor-targeting oncolytic virus that expresses an anti-B7-H3 antibody, e.g., single chain antibody, under the control of a promoter that is activated by low-oxygen conditions. In some embodiments, the genetically engineered bacterium or genetically engineered oncolytic virus express an anti-B7-H3 antibody, e.g., single chain antibody, under the control of a promoter that is activated by hypoxic conditions, or by inflammatory conditions, such as any of the promoters activated by said conditions and described herein. In some embodiments, the genetically engineered bacteria or genetically engineered OV expresses an anti-B7-H3 antibody, e.g., single chain antibody, under the control of a cancer-specific promoter, a tissue-specific promoter, or a constitutive promoter, such as any of the promoters described herein.

Hepatitis A virus cellular receptor 2 (HAVCR2), also known as T-cell immunoglobulin and mucin-domain containing-3 (TIM-3), is a Th1-specific cell surface protein that mediates T-cell exhaustion with other inhibitory receptors including programmed cell death protein 1 (PD1) and lymphocyte activation gene 3 protein (LAG3). TIM3, an immune checkpoint, regulates macrophage activation and may interact with the PD-1 pathway in the dysfunction of CD8+ T cells and Tregs in cancer. Thus, in certain embodiments, the genetically engineered bacteria or genetically engineered oncolytic viruses produce an anti-cancer molecule that inhibits TIM-3, for example, the genetically engineered microorganism may encode an antibody directed against Tim-3, e.g. a single-chain antibody against Tim-3. In some embodiments, the genetically engineered bacterium or genetically engineered oncolytic virus is a tumor-targeting bacterium or tumor-targeting oncolytic virus that expresses an anti-TIM-3 antibody, e.g., single chain antibody. In some embodiments, the genetically engineered bacterium or genetically engineered oncolytic virus expresses an anti-TIM-3 antibody, e.g., single chain antibody, under the control of a promoter that is activated by low-oxygen conditions. In some embodiments, the genetically engineered bacterium or genetically engineered oncolytic virus is a tumor-targeting bacteria or tumor-targeting oncolytic virus that expresses an anti-TIM-3 antibody, e.g., single chain antibody, under the control of a promoter that is activated by low-oxygen conditions. In some embodiments, the genetically engineered bacterium or genetically engineered oncolytic virus express an anti-TIM-3 antibody, e.g., single chain antibody, under the control of a promoter that is activated by hypoxic conditions, or by inflammatory conditions, such as any of the promoters activated by said conditions and described herein. In some embodiments, the genetically engineered bacteria or genetically engineered OV expresses an anti-TIM-3 antibody, e.g., single chain antibody, under the control of a cancer-specific promoter, a tissue-specific promoter, or a constitutive promoter, such as any of the promoters described herein.

Carcinoembryonic antigen-related cell adhesion molecule 1 (biliary glycoprotein) (CEACAM1) also known as CD66a (Cluster of Differentiation 66a), is an immune checkpoint which is a human glycoprotein belonging to the immunoglobulin superfamily. It functions as a cell-cell adhesion molecule detected on leukocytes, epithelia, and endothelia. CEACAM1 plays a role in angiogenesis, apoptosis, tumor suppression, metastasis, and the modulation of innate and adaptive immune responses. In certain embodiments, the genetically engineered bacteria or genetically engineered oncolytic viruses produce an anti-cancer molecule that inhibits CEACAM1, for example, the genetically engineered microorganism may encode an antibody directed against CEACAM1, e.g. a single-chain antibody against CEACAM1. In some embodiments, the genetically engineered bacterium or genetically engineered oncolytic virus is a tumor-targeting bacterium or tumor-targeting oncolytic virus that expresses an anti-CEACAM1 antibody, e.g., single chain antibody. In some embodiments, the genetically engineered bacterium or genetically engineered oncolytic virus expresses an anti-CEACAM1 antibody, e.g., single chain antibody, under the control of a promoter that is activated by low-oxygen conditions. In some embodiments, the genetically engineered bacterium or genetically engineered oncolytic virus is a tumor-targeting bacteria or tumor-targeting oncolytic virus that expresses an anti-CEACAM1 antibody, e.g., single chain antibody, under the control of a promoter that is activated by low-oxygen conditions. In some embodiments, the genetically engineered bacterium or genetically engineered oncolytic virus express an anti-CEACAM1 antibody, e.g., single chain antibody, under the control of a promoter that is activated by hypoxic conditions, or by inflammatory conditions, such as any of the promoters activated by said conditions and described herein. In some embodiments, the genetically engineered bacteria or genetically engineered OV expresses an anti-CEACAM1 antibody, e.g., single chain antibody, under the control of a cancer-specific promoter, a tissue-specific promoter, or a constitutive promoter, such as any of the promoters described herein.

Leukocyte-associated immunoglobulin-like receptor 1 (also known as CD305 (cluster of differentiation 305)) is an inhibitory receptor found on peripheral mononuclear cells, including NK cells, T cells, and B cells, that regulates the immune response to prevent lysis of cells recognized as self. Among other things, LAIR-1 can inhibit the cytotoxic activity of effector T cells upon CD3 binding or antigen stimulation, down-regulate Ig and cytokine production, and inhibit cytokine-mediated signals. LAIR-1 also inhibits the differentiation of peripheral blood precursors toward dendritic cells in vitro and GM-CSF-dependent proliferation. In certain embodiments, the genetically engineered bacteria or genetically engineered oncolytic viruses produce an anti-cancer molecule that inhibits LAIR-1, for example, the genetically engineered microorganism may encode an antibody directed against LAIR-1, e.g. a single-chain antibody against LAIR-1. In some embodiments, the genetically engineered bacterium or genetically engineered oncolytic virus is a tumor-targeting bacterium or tumor-targeting oncolytic virus that expresses an anti-LAIR-1 antibody, e.g., single chain antibody. In some embodiments, the genetically engineered bacterium or genetically engineered oncolytic virus expresses an anti-LAIR-1 antibody, e.g., single chain antibody, under the control of a promoter that is activated by low-oxygen conditions. In some embodiments, the genetically engineered bacterium or genetically engineered oncolytic virus is a tumor-targeting bacteria or tumor-targeting oncolytic virus that expresses an anti-LAIR-1 antibody, e.g., single chain antibody, under the control of a promoter that is activated by low-oxygen conditions. In some embodiments, the genetically engineered bacterium or genetically engineered oncolytic virus express an anti-LAIR-1 antibody, e.g., single chain antibody, under the control of a promoter that is activated by hypoxic conditions, or by inflammatory conditions, such as any of the promoters activated by said conditions and described herein. In some embodiments, the genetically engineered bacteria or genetically engineered OV expresses an anti-LAIR-! antibody, e.g., single chain antibody, under the control of a cancer-specific promoter, a tissue-specific promoter, or a constitutive promoter, such as any of the promoters described herein.

B- and T-lymphocyte attenuator BTLA (also known as CD272) is induced during the activation of T cells. BTLA displays T cell inhibition via interaction with tumor necrosis family receptors (TNF-R). BTLA is a ligand for tumour necrosis factor (receptor) superfamily, member 14 (TNFRSF14), also known as herpes virus entry mediator (HVEM). CD160 is also a ligand for HVEM, which binding delivers a coinhibitory signal. BTLA-HVEM complexes negatively regulate T-cell immune responses. In certain embodiments, the genetically engineered bacteria or genetically engineered oncolytic viruses produce an anti-cancer molecule that inhibits the binding of BTLA or CD160 to HVEM. In certain embodiments, the genetically engineered bacteria or genetically engineered oncolytic viruses produce an anti-cancer molecule that inhibits BLTA and/or an anti-cancer molecule that inhibits CD160 and/or an anti-cancer molecule that inhibits HVEM, for example, the genetically engineered microorganism may encode an antibody directed against BTLA and/or an antibody directed against CD160, and/or an HVEM antagonist (antagonist ligand or antibody), e.g. a single-chain antibody against BTLA and/or a single-chain antibody against CD160 and/or a single-chain antagonistic antibody against HVEM. In some embodiments, the genetically engineered bacterium or genetically engineered oncolytic virus is a tumor-targeting bacterium or tumor-targeting oncolytic virus that expresses an anti-BTLA antibody and/or an anti-CD160 antibody and/or an HVEM antagonist, e.g., a single chain antibody. In some embodiments, the genetically engineered bacterium or genetically engineered oncolytic virus expresses an anti-BTLA antibody and/or an anti-CD160 antibody and/or HVEM antagonist, e.g., single chain antibody, under the control of a promoter that is activated by low-oxygen conditions. In some embodiments, the genetically engineered bacterium or genetically engineered oncolytic virus is a tumor-targeting bacteria or tumor-targeting oncolytic virus that expresses an anti-BTLA antibody, and/or an anti-CD160 antibody, and/or an HVEM antagonist, e.g., single chain antibody, under the control of a promoter that is activated by low-oxygen conditions. In some embodiments, the genetically engineered bacterium or genetically engineered oncolytic virus express an an anti-BTLA antibody and/or an anti-CD160 antibody and/or HVEM antagonist, e.g., single chain antibody, under the control of a promoter that is activated by hypoxic conditions, or by inflammatory conditions, such as any of the promoters activated by said conditions and described herein. In some embodiments, the genetically engineered bacteria or genetically engineered OV expresses an an anti-BTLA antibody and/or an anti-CD160 antibody and/or HVEM antagonist, e.g., single chain antibody, under the control of a cancer-specific promoter, a tissue-specific promoter, or a constitutive promoter, such as any of the promoters described herein.

OX-2 membrane glycoprotein, also named CD200 (Cluster of Differentiation 200), is a type-1 membrane glycoprotein which, upon binding to CD200R1, regulates myeloid cell activity and delivers an inhibitory signal for the macrophage lineage in diverse tissues. CD200 receptor binding induces the plasmacytoid subset of splenic DCs (pDCs) to express the enzyme IDO, which initiates a tolerogenic pathway of tryptophan catabolism capable of suppressing antigen-specific responses in vivo. In peritoneal macrophages, IFNγ and IL-17-stimulated cytokine secretion is inhibited by CD200R1 engagement. CD200R1 engagement on monocytes also inhibits the secretion of IL-5 and IL-13 from human PBMCs. In certain embodiments, the genetically engineered bacteria or genetically engineered oncolytic viruses produce an anti-cancer molecule that inhibits the binding of CD200 to CD200R1. In certain embodiments, the genetically engineered bacteria or genetically engineered oncolytic viruses produce an anti-cancer molecule that inhibits CD200 and/or an anti-cancer molecule that inhibits CD200R1, for example, the genetically engineered microorganism may encode an antibody directed against CD200 and/or an antibody directed against CD200R1, e.g. a single-chain antibody against CD200 and/or a single chain antibody against CD200R1. In some embodiments, the genetically engineered bacterium or genetically engineered oncolytic virus is a tumor-targeting bacterium or tumor-targeting oncolytic virus that expresses an anti-CD200 antibody and/or an anti-CD200R1 antibody, e.g., a single chain antibody. In some embodiments, the genetically engineered bacterium or genetically engineered oncolytic virus expresses an anti-CD200 antibody and/or an anti-CD200R1 antibody, e.g., single chain antibody, under the control of a promoter that is activated by low-oxygen conditions. In some embodiments, the genetically engineered bacterium or genetically engineered oncolytic virus is a tumor-targeting bacteria or tumor-targeting oncolytic virus that expresses an anti-CD200 and/or anti-CD200R1 antibody, e.g., single chain antibody, under the control of a promoter that is activated by low-oxygen conditions. In some embodiments, the genetically engineered bacterium or genetically engineered oncolytic virus express an anti-CD200 antibody and/or an anti-CD200R1 antibody, e.g., single chain antibody, under the control of a promoter that is activated by hypoxic conditions, or by inflammatory conditions, such as any of the promoters activated by said conditions and described herein. In some embodiments, the genetically engineered bacteria or genetically engineered OV expresses an anti-CD200 antibody and/or an anti-CD200R1 antibody, e.g., single chain antibody, under the control of a cancer-specific promoter, a tissue-specific promoter, or a constitutive promoter, such as any of the promoters described herein.

MR (killer cell immunoglobulin-like receptor) is a receptor found on natural killer (NK) cells, which functions as an immune checkpoint. The interaction of MR with tumor ligands (e.g., HLAC) down-regulates NK cytotoxic activity and also mediates tolerance and reduces graft versus host disease in allogenic stem cell transplantation. MR has been found to be immunosuppressive in lung cancer cells. In certain embodiments, the genetically engineered bacteria or genetically engineered oncolytic viruses produce an anti-cancer molecule that inhibits MR, for example, the genetically engineered microorganism may encode an antibody directed against MR, e.g. a single-chain antibody against MR. In some embodiments, the genetically engineered bacterium or genetically engineered oncolytic virus is a tumor-targeting bacterium or tumor-targeting oncolytic virus that expresses an anti-MR antibody, e.g., a single chain antibody. In some embodiments, the genetically engineered bacterium or genetically engineered oncolytic virus expresses an anti-MR antibody, e.g., single chain antibody, under the control of a promoter that is activated by low-oxygen conditions. In some embodiments, the genetically engineered bacterium or genetically engineered oncolytic virus is a tumor-targeting bacteria or tumor-targeting oncolytic virus that expresses an anti-MR antibody, e.g., single chain antibody, under the control of a promoter that is activated by low-oxygen conditions. In some embodiments, the genetically engineered bacterium or genetically engineered oncolytic virus express an anti-MR antibody, e.g., single chain antibody, under the control of a promoter that is activated by hypoxic conditions, or by inflammatory conditions, such as any of the promoters activated by said conditions and described herein. In some embodiments, the genetically engineered bacteria or genetically engineered OV expresses an anti-MR antibody, e.g., single chain antibody, under the control of a cancer-specific promoter, a tissue-specific promoter, or a constitutive promoter, such as any of the promoters described herein.

Adenosine, acting via the $A_{2A}$ adenosine receptor (A2aR), is emerging as an important inhibitor of immune function. While extracellular adenosine levels are typically very low, tissue breakdown and hypoxia (common to inflammatory and tumor microenvironments) generate high levels of extracellular adenosine. The maintenance of relatively high levels of adenosine in the tumor microenvironment suggests that tumor-derived adenosine is one mechanism by which cancers evade immune destruction. Extracellular adenosine signalling through A2a and A2b receptors—expressed on a variety of immune cell subsets and endothelial cells—has been established as having an important role in protecting tissues during inflammatory responses. Recent studies have confirmed that adenosine in the immune microenvironment leading to the activation of the A2a receptor represent a checkpoint pathway active in the tumor microenvironment. Further studies have demonstrated the ability of A2a receptor blockade to enhance tumor vaccines, checkpoint blockade and adoptive T cell therapy. Through these and other studies a picture has emerged of adenosinergic signaling through A2aR as a negative feedback loop that regulates local and systemic inflammatory response. In certain embodiments, the genetically engineered bacteria or genetically engineered oncolytic viruses produce an anti-cancer molecule that inhibits A2aR, for example, the genetically engineered microorganism may encode an antibody directed against A2aR, e.g. a single-chain antibody against A2aR. In some embodiments, the genetically engineered bacterium or genetically engineered oncolytic virus is a tumor-targeting bacterium or tumor-targeting oncolytic virus that expresses an anti-A2aR antibody, e.g., a single chain antibody. In some embodiments, the genetically engineered bacterium or genetically engineered oncolytic virus expresses an anti-A2aR antibody, e.g., single chain antibody, under the control of a promoter that is activated by low-oxygen conditions. In some embodiments, the genetically engineered bacterium or genetically engineered oncolytic virus is a tumor-targeting bacteria or tumor-targeting oncolytic virus that expresses an anti-A2aR antibody, e.g., single chain antibody, under the control of a promoter that is activated by low-oxygen conditions. In some embodiments, the genetically engineered bacterium or genetically engineered oncolytic virus express an anti-A2aR antibody, e.g., single chain antibody, under the control of a promoter that is activated by hypoxic conditions, or by inflammatory conditions, such as any of the promoters activated by said conditions and described herein. In some embodiments, the genetically engineered bacteria or genetically engineered OV expresses an anti-A2aR antibody, e.g., single chain antibody, under the control of a cancer-specific promoter, a tissue-specific promoter, or a constitutive promoter, such as any of the promoters described herein.

In some embodiments, the genetically engineered microorganisms, e.g., genetically engineered bacteria or genetically engineered oncolytic viruses are capable of producing two or more anti-cancer molecules, e.g., two, three, four, five, six or more anti-cancer molecules, for example, two or more immune checkpoint inhibitors. In certain embodiments, the genetically engineered bacteria or genetically engineered oncolytic viruses produce an anti-CTLA-4 antibody and an antibody against one or more checkpoints selected from PD-1, PD-L1, PD-L2, TIGIT, VISTA, LAG-3, TIM1, TIM3, CEACAM1, LAIR-1, HVEM, BTLA, CD160, CD200, CD200R, CD39, CD73, B7-H3, B7-H4, IDO, TDO, KIR, and A2aR. In certain embodiments, the genetically engineered bacteria or genetically engineered oncolytic viruses produce an anti-PD-1 antibody and an antibody against one or more checkpoints selected from CTLA-4, PD-L1, PD-L2, TIGIT, VISTA, LAG-3, TIM1, TIM3, CEACAM1, LAIR-1, HVEM, BTLA, CD160, CD200, CD200R, CD39, CD73, B7-H3, B7-H4, IDO, TDO, KIR, and A2aR. In certain embodiments, the genetically engineered bacteria or genetically engineered oncolytic viruses produce an anti-MR antibody and an antibody against one or more checkpoints selected from CTLA-4, PD-1, PD-L1, PD-L2, TIGIT, VISTA, LAG-3, TIM1, TIM3, CEACAM1, LAIR-1, HVEM, BTLA, CD160, CD200, CD200R, CD39, CD73, B7-H3, B7-H4, IDO, TDO, and A2aR. In certain embodiments, the genetically engineered bacteria or genetically engineered oncolytic viruses produce an anti-LAG5 antibody and an antibody against one or more checkpoints selected from CTLA-4, PD-1, PD-L1, PD-L2, TIGIT, VISTA, TIM1, TIM3, CEACAM1, LAIR-1, HVEM, BTLA, CD160, CD200, CD200R, CD39, CD73, B7-H3, B7-H4, IDO, TDO, KIR, and A2aR. In certain embodiments, the genetically engineered bacteria or genetically engineered oncolytic viruses produce an anti-TIM3 antibody and an antibody against one or more checkpoints selected from CTLA-4, PD-1, PD-L1, PD-L2, TIGIT, VISTA, LAG-3, TIM1, CEACAM1, LAIR-1, HVEM, BTLA, CD160, CD200, CD200R, CD39, CD73, B7-H3, B7-H4, IDO, TDO, KIR, and A2aR. In certain embodiments, the genetically engineered bacteria or genetically engineered oncolytic viruses produce an anti-A2aR antibody and an antibody against one or more checkpoints selected from CTLA-4, PD-1, PD-L1, PD-L2, TIGIT, VISTA, LAG-3, TIM1, TIM3, CEACAM1, LAIR-1, HVEM, BTLA, CD160, CD200, CD200R, CD39, CD73, B7-H3, B7-H4, IDO, TDO, and MR. In any of these embodiments, the anti-immune checkpoint antibody can be a single chain antibody. In any of these embodiments, the genetically engineered bacterium or genetically engineered oncolytic virus is a tumor-targeting bacterium or tumor-targeting oncolytic virus. In some embodiments, the genetically engineered bacterium or genetically engineered oncolytic virus express one or more single chain antibodies against one or more immune checkpoints, under the control of a promoter that is activated by low-oxygen conditions, by hypoxic conditions, or by inflammatory conditions, such as any of the promoters activated by said conditions and described herein. In some embodiments, the genetically engineered bacteria or genetically engineered OV expresses one or more single chain antibodies against one or more immune checkpoints, under the control of a cancer-specific promoter, a tissue-specific promoter, or a constitutive promoter, such as any of the promoters described herein.

TABLE 3

| Description | SEQUENCE |
|---|---|
| Heavy chain (humanized) SEQ ID NO: 1 | QVQLVQSGVEVKKPGASVKVSCKASGYTFTNYYMYWVRQAPG QGLEWMGGINPSNGGTNFNEKFKNRVTLTTDSSTTTAYMELKSL QFDDTAVYYCARRDYRFDMGFDYWGQGTTVTVSSASTKGPSVF PLAPCSRSTSESTAALGCLVKDYFPEPVTVSWNSGALTSGVHTFP AVLQSSGLYSLSSVVTVPSSSLGTKTYTCNVDHKPSNTKVDKRVES KYGPPCPPCPAPEFLGGPSVFLFPPKPKDTLMISRTPEVTCVVVDV SQEDPEVQFNWYVDGVEVHNAKTKPREEQFNSTYRVVSVLTVL HQDWLNGKEYKCKVSNKGLPSSIEKTISKAKGQPREPQVYTLPPS QEEMTKNQVSLTCLVKGFYPSDIAVEWESNGQPENNYKTTPPVL DSDGSFFLYSRLTVDKSRWQEGNVFSCSVMHEALHNHYTQKSLS LSLGK |
| Light chain (humanized) SEQ ID NO: 2 | EIVLTQSPATLSLSPGERATLSCRASKGVSTSGYSYLHWYQQKPGQ APRLLIYLASYLESGVPARFSGSGSGTDFTLTISSLEPEDFAVYYCQH SRDLPLTFGGGTKVEIKRTVAAPSVFIFPPSDEQLKSGTASVVCLLN NFYPREAKVQWKVDNALQSGNSQESVTEQDSKDSTYSLSSTLTLS KADYEKHKVYACEVTHQGLSSPVTKSFNRGEC |
| Heavy chain (human monoclonal) SEQ ID NO: 3 | QVQLVESGGGVVQPGRSLRLDCKASGITFSNSGMHWVRQAPGK GLEWVAVIWYDGSKRYYADSVKGRFTISRDNSKNTLFLQMNSLR AEDTAVYYCATNDDYWGQGTLVTVSSASTKGPSVFPLAPCSRSTS ESTAALGCLVKDYFPEPVTVSWNSGALTSGVHTFPAVLQSSGLYS LSSVVTVPSSSLGTKTYTCNVDHKPSNTKVDKRVESKYGPPCPPCP APEFLGGPSVFLFPPKPKDTLMISRTPEVTCVVVDVSQEDPEVQF NWYVDGVEVHNAKTKPREEQFNSTYRVVSVLTVLHQDWLNGKE YKCKVSNKGLPSSIEKTISKAKGQPREPQVYTLPPSQEEMTKNQVS LTCLVKGFYPSDIAVEWESNGQPENNYKTTPPVLDSDGSFFLYSRL TVDKSRWQEGNVFSCSVMHEALHNHYTQKSLSLSLGK |

TABLE 3-continued

| Description | SEQUENCE |
|---|---|
| Light chain (human monoclonal) SEQ ID NO: 4 | EIVLTQSPATLSLSPGERATLSCRASQSVSSYLAWYQQKPGQAPRL LIYDASNRATGIPARFSGSGSGTDFTLTISSLEPEDFAVYYCQQSSN WPRTFGQGTKVEIKRTVAAPSVFIFPPSDEQLKSGTASVVCLLNNF YPREAKVQWKVDNALQSGNSQESVTEQDSKDSTYSLSSTLTLSKA DYEKHKVYACEVTHQGLSSPVTKSFNRGEC |

In some embodiments, the sequence is at least about 80%, at least about 85%, at least about 90%, at least about 95%, or at least about 99% homologous to the sequence of SEQ ID NO: 1, SEQ ID NO: 2, SEQ ID NO: 3, and/or SEQ ID NO: 4.

Additional sequences for use in constructing single chain antibody sequences can be found in Table 4.

TABLE 4

| Antibody | Target | Description | Sequence |
|---|---|---|---|
| Ipilimumab SEQ ID NO: 5 | CTLA-4 | Heavy chain | QVQLVESGGGVVQPGRSLRLSCAASGFTFSSYTMH WVRQAPGKGLEWVTFISYDGNNKYYADSVKGRFT ISRDNSKNTLYLQMNSLRAEDTAIYYCARTGWLGP FDYWGQGTLVTVSSASTKGPSVFPLAPSSKSTSGGT AALGCLVKDYFPEPVTVSWNSGALTSGVHTFPAVL QSSGLYSLSSVVTVPSSSLGTQTYICNVNHKPSNTK VDKRVEPKSCDKTHTCPPCPAPELLGGPSVFLFPPK PKDTLMISRTPEVTCVVVDVSHEDPEVKFNWYVD GVEVHNAKTKPREEQYNSTYRVVSVLTVLHQDWL NGKEYKCKVSNKALPAPIEKTISKAKGQPREPQVYT LPPSRDELTKNQVSLTCLVKGFYPSDIAVEWESNGQ PENNYKTTPPVLDSDGSFFLYSKLTVDKSRWQQGN VFSCSVMHEALHNHYTQKSLSLSPGK |
| Ipilimumab SEQ ID NO: 6 | CTLA-4 | Heavy chain variable region | QVQLVESGGGVVQPGRSLRLSCAASGFTFSSYTMH WVRQAPGKGLEWVTFISYDGNNKYYADSVKGRFT ISRDNSKNTLYLQMNSLRAEDTAIYYCARTGWLGP FDYWGQGTLVTVSS |
| Ipilimumab SEQ ID NO: 7 | CTLA-4 | Light chain | EIVLTQSPGTLSLSPGERATLSCRASQSVGSSYLAWY QQKPGQAPRLLIYGAFSRATGIPDRFSGSGSGTDFT LTISRLEPEDFAVYYCQQYGSSPWTFGQGTKVEIKR TVAAPSVFIFPPSDEQLKSGTASVVCLLNNFYPREAK VQWKVDNALQSGNSQESVTEQDSKDSTYSLSSTLT LSKADYEKHKVYACEVTHQGLSSPVTKSFNRGEC |
| Ipilimumab SEQ ID NO: 8 | CTLA-4 | Light chain variable region | EIVLTQSPGTLSLSPGERATLSCRASQSVGSSYLAWY QQKPGQAPRLLIYGAFSRATGIPDRFSGSGSGTDFT LTISRLEPEDFAVYYCQQYGSSPWTFGQGTKVEIK |
| Tremelimumab (CP675206) SEQ ID NO: 9 | CTLA-4 | Heavy chain | PGKGLEWVAVIWYDGSNKYYADSVKGRFTISRDNS KNTLYLQMNSLRAEDTAVYYCARDPRGATLYYYY GMDVWGQGTTVTVSSASTKGPSVFPLAPCSRSTSE STAALGCLVKDYFPEPVTVSWNSGALTSGVHTFPA VLQSSGLYSLSSVVTVPSSNFGTQTYTCNVDHKPSN TKVDKTVERKCCVECPPCPAPPVAGPSVFLFPPKPK DTLMISRTPEVTCVVVDVSHEDPEVQFNWYVDGV EVHNAKTKPREEQFNSTFRVVSVLTVVHQDWLNG KEYKCKVSNKGLPAPIEKTISKTKGQPREPQVYTLPP SREEMTKNQVSLTCLVKGFYPSDIAVEWESNGQPE NNYKTTPPMLDSDGSFFLYSKLTVDKSRWQQGNV FSCSVMHEALHNHYTQKSLSLSPGK |
| Tremelimumab (CP675206) SEQ ID NO: 10 | CTLA-4 | Light chain | DIQMTQSPSSLSASVGDRVTITCRASQSINSYLDWY QQKPGKAPKLLIYAASSLQSGVPSRFSGSGSGTDFT LTISSLQPEDFATYYCQQYYSTPFFTGPGTKVEIKRT VAAPSVFIFPPSDEQLKSGTASVVCLLNNFYPREAK VQWKVDNALQSGNSQESVTEQDSKDSTYSLSSTLT LSKADYEKHKVYACEVTHQGLSSPVTKSFNRGEC |
| PF-05082566 SEQ ID NO: 11 | 4-1BB (CD137, TNFRSF9) | Heavy chain | EVQLVQSGAEVKKPGESLRISCKGSGYSFSTYWISW VRQMPGKGLEWMGKIYPGDSYTNYSPSFQGQVTI SADKSISTAYLQWSSLKASDTAMYYCARGYGIFDY WGQGTLVTVSSASTKGPSVFPLAPCSRSTSESTAAL GCLVKDYFPEPVTVSWNSGALTSGVHTFPAVLQSS GLYSLSSVVTVPSSNFGTQTYTCNVDHKPSNTKVDK |

TABLE 4-continued

| Antibody | Target | Description | Sequence |
|---|---|---|---|
| | | | TVERKCCVECPPCPAPPVAGPSVFLFPPKPKDTLMI SRTPEVTCVVVDVSHEDPEVQFNWYVDGVEVHNA KTKPREEQFNSTFRVVSVLTVVHQDWLNGKEYKCK VSNKGLPAPIEKTISKTKGQPREPQVYTLPPSREEM TKNQVSLTCLVKGFYPSDIAVEWESNGQPENNYKT TPPMLDSDGSFFLYSKLTVDKSRWQQGNVFSCSV MHEALHNHYTQKSLSLSPGK |
| PF-05082566 SEQ ID NO: 12 | 4-1BB (CD137, TNFRSF9) | Light chain | SYELTQPPSVSVSPGQTASITCSGDNIGDQYAHWY QQKPGQSPVLVIYQDKNRPSGIPERFSGSNSGNTA TLTISGTQAMDEADYYCATYTGFGSLAVFGGGTKL TVLGQPKAAPSVTLFPPSSEELQANKATLVCLISDFY PGAVTVAWKADSSPVKAGVETTTPSKQSNNKYAA SSYLSLTPEQWKSHRSYSCQVTHEGSTVEKTVAPTE CS |
| Urelumab SEQ ID NO: 13 | 4-1BB (CD137, TNFRSF9) | Heavy chain | QVQLQQWGAGLLKPSETLSLTCAVYGGSFSGYYW SWIRQSPEKGLEWIGEINHGGYVTYNPSLESRVTIS VDTSKNQFSLKLSSVTAADTAVYYCARDYGPGNYD WYFDLWGRGTLVTVSSASTKGPSVFPLAPCSRSTSE STAALGCLVKDYFPEPVTVSWNSGALTSGVHTFPA VLQSSGLYSLSSVVTVPSSSLGTKTYTCNVDHKPSNT KVDKRVESKYGPPCPPCPAPEFLGGPSVFLFPPKPK DTLMISRTPEVTCVVVDVSQEDPEVQFNWYVDGV EVHNAKTKPREEQFNSTYRVVSVLTVLHQDWLNG KEYKCKVSNKGLPSSIEKTISKAKGQPREPQVYTLPP SQEEMTKNQVSLTCLVKGFYPSDIAVEWESNGQPE NNYKTTPPVLDSDGSFFLYSRLTVDKSRWQEGNVF SCSVMHEALHNHYTQKSLSLSLGK |
| Urelumab SEQ ID NO: 14 | 4-1BB (CD137, TNFRSF9) | Light chain | EIVLTQSPATLSLSPGERATLSCRASQSVSSYLAWYQ QKPGQAPRLLIYDASNRATGIPARFSGSGSGTDFTL TISSLEPEDFAVYYCQQRSNWPPALTFCGGTKVEIK RTVAAPSVFIFPPSDEQLKSGTASVVCLLNNFYPREA KVQWKVDNALQSGNSQESVTEQDSKDSTYSLSSTL TLSKADYEKHKVYACEVTHQGLSSPVTKSFNRGEC |
| Anti-OX40 antibody (Providence Health and Services) SEQ ID NO: 15 | CD134 (OX40) | Heavy chain | EVQLVESGGGLVQPGGSLRLSCAASGFTFTNYGIH WIRQAPGKGLEWVASISPSGGLTYYRDSVKGRFTIS RDDAKNSPYLQMNSLRAEDTAVYYCATGGEGIFDY WGQGTLVTVSS |
| Anti-OX40 antibody (Providence Health and Services) SEQ ID NO: 16 | CD134 (OX40) | Light chain | DIQMTQSPSSLSASVGDRVTITCRATQSIYNALAWY QQKPGKAPKLLIYNANTLHTGVPSRFSASGSGTDST LTISSLQPEDFATYYCQQYYDYPLTFGGGTKVEIKR |
| Nivolumab SEQ ID NO: 17 | PD-1 | Heavy chain | QVQLVESGGGVVQPGRSLRLDCKASGITFSNSGM HWVRQAPGKGLEWVAVIWYDGSKRYYADSVKGR FTISRDNSKNTLFLQMNSLRAEDTAVYYCATNDDY WGQGTLVTVSSASTKGPSVFPLAPCSRSTSESTAAL GCLVKDYFPEPVTVSWNSGALTSGVHTFPAVLQSS GLYSLSSVVTVPSSSLGTKTYTCNVDHKPSNTKVDK RVESKYGPPCPPCPAPEFLGGPSVFLFPPKPKDTLM ISRTPEVTCVVVDVSQEDPEVQFNWYVDGVEVHN AKTKPREEQFNSTYRVVSVLTVLHQDWLNGKEYKC KVSNKGLPSSIEKTISKAKGQPREPQVYTLPPSQEE MTKNQVSLTCLVKGFYPSDIAVEWESNGQPENNY KTTPPVLDSDGSFFLYSRLTVDKSRWQEGNVFSCSV MHEALHNHYTQKSLSLSLGK |
| Nivolumab SEQ ID NO: 18 | PD-1 | Heavy chain variable region | QVQLVESGGGVVQPGRSLRLDCKASGITFSNSGM HWVRQAPGKGLEWVAVIWYDGSKRYYADSVKGR FTISRDNSKNTLFLQMNSLRAEDTAVYYCATNDDY WGQGTLVTVSS |
| Nivolumab SEQ ID NO: 19 | PD-1 | Light chain | EIVLTQSPATLSLSPGERATLSCRASQSVSSYLAWYQ QKPGQAPRLLIYDASNRATGIPARFSGSGSGTDFTL TISSLEPEDFAVYYCQQSSNWPRTFGQGTKVEIKRT VAAPSVFIFPPSDEQLKSGTASVVCLLNNFYPREAK VQWKVDNALQSGNSQESVTEQDSKDSTYSLSSTLT LSKADYEKHKVYACEVTHQGLSSPVTKSFNRGEC |

TABLE 4-continued

| Antibody | Target | Description | Sequence |
|---|---|---|---|
| Nivolumab SEQ ID NO: 20 | PD-1 | Light chain variable region | EIVLTQSPATLSLSPGERATLSCRASQSVSSYLAWYQ QKPGQAPRLLIYDASNRATGIPARFSGSGSGTDFTL TISSLEPEDFAVYYCQQSSNWPRTFGQGTKVEIK |
| Pidilizumab SEQ ID NO: 21 | PD-1 | Heavy chain | QVQLVQSGSELKKPGASVKISCKASGYTFTNYGMN WVRQAPGQGLQWMGWINTDSGESTYAEEFKGR FVFSLDTSVNTAYLQITSLTAEDTGMYFCVRVGYDA LDYWGQGTLVTVSSASTKGPSVFPLAPSSKSTSGGT AALGCLVKDYFPEPVTVSWNSGALTSGVHTFPAVL QSSGLYSLSSVVTVPSSSLGTQTYICNVNHKPSNTK VDKRVEPKSCDKTHTCPPCPAPELLGGPSVFLFPPK PKDTLMISRTPEVTCVVVDVSHEDPEVKFNWYVD GVEVHNAKTKPREEQYNSTYRVVSVLTVLHQDWL NGKEYKCKVSNKALPAPIEKTISKAKGQPREPQVYT LPPSREEMTKNQVSLTCLVKGFYPSDIAVEWESNG QPENNYKTTPPVLDSDGSFFLYSKLTVDKSRWQQG NVFSCSVMHEALHNHYTQKSLSLSPGK |
| Pidilizumab SEQ ID NO: 22 | PD-1 | Heavy chain variable region As described in WO2009101611 | |
| Pidilizumab SEQ ID NO: 23 | PD-1 | Light chain | EIVLTQSPSSLSASVGDRVTITCSARSSVSYMHWFQ QKPGKAPKLWIYRTSNLASGVPSRFSGSGSGTSYCL TINSLQPEDFATYYCQQRSSFPLTFGGGTKLEIKRTV AAPSVFIFPPSDEQLKSGTASVVCLLNNFYPREAKV QWKVDNALQSGNSQESVTEQDSKDSTYSLSSTLTL SKADYEKHKVYACEVTHQGLSSPVTKSFNRGEC |
| Pidilizumab SEQ ID NO: 24 | PD-1 | Light chain variable region As described in WO2009101611 | |
| Pembrolizumab (MK-3475/SCH900475, lambrolizumab) SEQ ID NO: 25 | PD-1 | Heavy chain | QVQLVQSGVEVKKPGASVKVSCKASGYTFTNYYM YWVRQAPGQGLEWMGGINPSNGGTNFNEKFKN RVTLTTDSSTTTAYMELKSLQFDDTAVYYCARRDYR FDMGFDYWGQGTTVTVSSASTKGPSVFPLAPCSRS TSESTAALGCLVKDYFPEPVTVSWNSGALTSGVHT PAVLQSSGLYSLSSVVTVPSSSLGTKTYTCNVDHKPS NTKVDKRVESKYGPPCPPCPAPEFLGGPSVFLFPPK PKDTLMISRTPEVTCVVVDVSQEDPEVQFNWYVD GVEVHNAKTKPREEQFNSTYRVVSVLTVLHQDWL NGKEYKCKVSNKGLPSSIEKTISKAKGQPREPQVYTL PPSQEEMTKNQVSLTCLVKGFYPSDIAVEWESNGQ PENNYKTTPPVLDSDGSFFLYSRLTVDKSRWQEGN VFSCSVMHEALHNHYTQKSLSLSLGK |
| Pembrolizumab (MK-3475/SCH900475, lambrolizumab) SEQ ID NO: 26 | PD-1 | Light chain; Heavy chain variable region is described in as described in WO2009114335 | EIVLTQSPATLSLSPGERATLSCRASKGVSTSGYSYLH WYQQKPGQAPRLLIYLASYLESGVPARFSGSGSGT DFTLTISSLEPEDFAVYYCQHSRDLPLTFGGGTKVEI KRTVAAPSVFIFPPSDEQLKSGTASVVCLLNNFYPRE AKVQWKVDNALQSGNSQESVTEQDSKDSTYSLSS TLTLSKADYEKHKVYACEVTHQGLSSPVTKSFNRGEC |
| Durvalumab (MEDI4736) SEQ ID NO: 27 | PD-L1 | Heavy chain | EVQLVESGGGLVQPGGSLRLSCAASGFTFSRYWM SWVRQAPGKGLEWVANIKQDGSEKYYVDSVKGRF TISRDNAKNSLYLQMNSLRAEDTAVYYCAREGGW FGELAFDYWGQGTLVTVSSASTKGPSVFPLAPSSKS TSGGTAALGCLVKDYFPEPVTVSWNSGALTSGVHT FPAVLQSSGLYSLSSVVTVPSSSLGTQTYICNVNHKP SNTKVDKRVEPKSCDKTHTCPPCPAPEFEGGPSVFL FPPKPKDTLMISRTPEVTCVVVDVSHEDPEVKFNW YVDGVEVHNAKTKPREEQYNSTYRVVSVLTVLHQD WLNGKEYKCKVSNKALPASIEKTISKAKGQPREPQV YTLPPSREEMTKNQVSLTCLVKGFYPSDIAVEWESN GQPENNYKTTPPVLDSDGSFFLYSKLTVDKSRWQQ GNVFSCSVMHEALHNHYTQKSLSLSPGK |

TABLE 4-continued

| Antibody | Target | Description | Sequence |
|---|---|---|---|
| Durvalumab (MEDI4736) SEQ ID NO: 28 | PD-L1 | Light chain | EIVLTQSPGTLSLSPGERATLSCRASQRVSSSYLAWY QQKPGQAPRLLIYDASSRATGIPDRFSGSGSGTDFT LTISRLEPEDFAVYYCQQYGSLPWTFGQGTKVEIKR TVAAPSVFIFPPSDEQLKSGTASVVCLLNNFYPREAK VQWKVDNALQSGNSQESVTEQDSKDSTYSLSSTLT LSKADYEKHKVYACEVTHQGLSSPVTKSFNRGEC |
| Lirilumab SEQ ID NO: 29 | KIR | Heavy chain | QVQLVQSGAEVKKPGSSVKVSCKASGGTFSFYAIS WVRQAPGQGLEWMGGFIPIFGAANYAQKFQGRV TITADESTSTAYMELSSLRSDDTAVYYCARIPSGSYY YDYDMDVWGQGTTVTVSSASTKGPSVFPLAPCSR STSESTAALGCLVKDYFPEPVTVSWNSGALTSGVHT FPAVLQSSGLYSLSSVVTVPSSSLGTKTYTCNVDHKP SNTKVDKRVESKYGPPCPPCPAPEFLGGPSVFLFPP KPKDTLMISRTPEVTCVVVDVSQEDPEVQFNWYV DGVEVHNAKTKPREEQFNSTYRVVSVLTVLHQDW LNGKEYKCKVSNKGLPSSIEKTISKAKGQPREPQVYT LPPSQEEMTKNQVSLTCLVKGFYPSDIAVEWESNG QPENNYKTTPPVLDSDGSFFLYSRLTVDKSRWQEG NVFSCSVMHEALHNHYTQKSLSLSLGK |
| Lirilumab SEQ ID NO: 30 | KIR | Light chain | EIVLTQSPVTLSLSPGERATLSCRASQSVSSYLAWYQ QKPGQAPRLLIYDASNRATGIPARFSGSGSGTDFTL TISSLEPEDFAVYYCQQRSNWMYTFGQGTKLEIKRT VAAPSVFIFPPSDEQLKSGTASVVCLLNNFYPREAK VQWKVDNALQSGNSQESVTEQDSKDSTYSLSSTLT LSKADYEKHKVYACEVTHQGLSSPVTKSFNRGEC |
| BMS-986016 SEQ ID NO: 31 | LAG3 | Heavy chain | QVQLQQWGAGLLKPSETLSLTCAVYGGSFSDYYW NWIRQPPGKGLEWIGEINHRGSTNSNPSLKSRVTL SLDTSKNQFSLKLRSVTAADTAVYYCAFGYSDYEYN WFDPWGQGTLVTVSSASTKGPSVFPLAPCSRSTSE STAALGCLVKDYFPEPVTVSWNSGALTSGVHTFPA VLQSSGLYSLSSVVTVPSSSLGTKTYTCNVDHKPSNT KVDKRVESKYGPPCPPCPAPEFLGGPSVFLFPPKPK DTLMISRTPEVTCVVVDVSQEDPEVQFNWYVDGV EVHNAKTKPREEQFNSTYRVVSVLTVLHQDWLNG KEYKCKVSNKGLPSSIEKTISKAKGQPREPQVYTLPP SQEEMTKNQVSLTCLVKGFYPSDIAVEWESNGQPE NNYKTTPPVLDSDGSFFLYSRLTVDKSRWQEGNVF SCSVMHEALHNHYTQKSLSLSLGK |
| BMS986016 SEQ ID NO: 32 | LAG3 | Light chain | EIVLTQSPATLSLSPGERATLSCRASQSISSYLAWYQ QKPGQAPRLLIYDASNRATGIPARFSGSGSGTDFTL TISSLEPEDFAVYYCQQRSNWPLTFGQGTNLEIKRT VAAPSVFIFPPSDEQLKSGTASVVCLLNNFYPREAK VQWKVDNALQSGNSQESVTEQDSKDSTYSLSSTLT LSKADYEKHKVYACEVTHQGLSSPVTKSFNRGEC |
| Avelumab (MSB0010718C) SEQ ID NO: 33 | PD-L1 | Heavy chain | EVQLLESGGGLVQPGGSLRLSCAASGFTFSSYIMM WVRQAPGKGLEWVSSIYPSGGITFYADTVKGRFTIS RDNSKNTLYLQMNSLRAEDTAVYYCARIKLGTVTT VDYWGQGTLVTVSSASTKGPSVFPLAPSSKSTSGG TAALGCLVKDYFPEPVTVSWNSGALTSGVHTFPAV LQSSGLYSLSSVVTVPSSSLGTQTYICNVNHKPSNTK VDKKVEPKSCDKTHTCPPCPAPELLGGPSVFLFPPK PKDTLMISRTPEVTCVVVDVSHEDPEVKFNWYVD GVEVHNAKTKPREEQYNSTYRVVSVLTVLHQDWL NGKEYKCKVSNKALPAPIEKTISKAKGQPREPQVYT LPPSRDELTKNQVSLTCLVKGFYPSDIAVEWESNGQ PENNYKTTPPVLDSDGSFFLYSKLTVDKSRWQQGN VFSCSVMHEALHNHYTQKSLSLSPGK |
| Avelumab (MSB0010718C) SEQ ID NO: 34 | PD-L1 | Light chain | QSALTQPASVSGSPGQSITISCTGTSSDVGGYNYVS WYQQHPGKAPKLMIYDVSNRPSGVSNRFSGSKSG NTASLTISGLQAEDEADYYCSSYTSSSTRVFGTGTKV TVLGQPKANPTVTLFPPSSEELQANKATLVCLISDFY PGAVTVAWKADGSPVKAGVETTKPSKQSNNKYAA SSYLSLTPEQWKSHRSYSCQVTHEGSTVEKTVAPTE CS |
| Atezolizumab (MPDL3280A, RG7446, RO5541267) SEQ ID NO: 35 | PD-L1 | Heavy chain | EVQLVESGGGLVQPGGSLRLSCAASGFTFSDSWIH WVRQAPGKGLEWVAWISPYGGSTYYADSVKGRFT ISADTSKNTAYLQMNSLRAEDTAVYYCARRHWPG GFDYWGQGTLVTVSSASTKGPSVFPLAPSSKSTSG GTAALGCLVKDYFPEPVTVSWNSGALTSGVHTFPA VLQSSGLYSLSSVVTVPSSSLGTQTYICNVNHKPSNT KVDKKVEPKSCDKTHTCPPCPAPELLGGPSVFLFPP |

TABLE 4-continued

| Antibody | Target | Description | Sequence |
|---|---|---|---|
| | | | KPKDTLMISRTPEVTCVVVDVSHEDPEVKFNWYVD GVEVHNAKTKPREEQYASTYRVVSVLTVLHQDWL NGKEYKCKVSNKALPAPIEKTISKAKGQPREPQVYT LPPSREEMTKNQVSLTCLVKGFYPSDIAVEWESNG QPENNYKTTPPVLDSDGSFFLYSKLTVDKSRWQQG NVFSCSVMHEALHNHYTQKSLSLSPGK |
| Atezolizumab (MPDL3280A, RG7446, RO5541267) SEQ ID NO: 36 | PD-L1 | Heavy chain variable region | EVQLVESGGGLVQPGGSLRLSCAASGFTFSDSWIH WVRQAPGKGLEWVAWISPYGGSTYYADSVKGRFT ISADTSKNTAYLQMNSLRAEDTAVYYCARRHWPG GFDYWGQGTLVTVSS |
| Atezolizumab (MPDL3280A, RG7446, RO5541267) SEQ ID NO: 37 | PD-L1 | Light chain | DIQMTQSPSSLSASVGDRVTITCRASQDVSTAVAW YQQKPGKAPKLLIYSASFLYSGVPSRFSGSGSGTDFT LTISSLQPEDFATYYCQQYLYHPATFGQGTKVEIKRT VAAPSVFIFPPSDEQLKSGTASVVCLLNNFYPREAK VQWKVDNALQSGNSQESVTEQDSKDSTYSLSSTLT LSKADYEKHKVYACEVTHQGLSSPVTKSFNRGEC |
| Atezolizumab (MPDL3280A, RG7446, RO5541267) SEQ ID NO: 38 | PD-L1 | Light chain variable region | DIQMTQSPSSLSASVGDRVTITCRASQDVSTAVAW YQQKPGKAPKLLIYSASFLYSGVPSRFSGSGSGTDFT LTISSLQPEDFATYYCQQYLYHPATFGQGTKVEIKR |
| Mogamulizumab SEQ ID NO: 39 | CCR4 | Heavy chain | EVQLVESGGDLVQPGRSLRLSCAASGFIFSNYGMS WVRQAPGKGLEWVATISSASTYSYYPDSVKGRFTIS RDNAKNSLYLQMNSLRVEDTALYYCGRHSDGNFA FGYWGQGTLVTVSSASTKGPSVFPLAPSSKSTSGGT AALGCLVKDYFPEPVTVSWNSGALTSGVHTFPAVL QSSGLYSLSSVVTVPSSSLGTQTYICNVNHKPSNTK VDKKVEPKSCDKTHTCPPCPAPELLGGPSVFLFPPK PKDTLMISRTPEVTCVVVDVSHEDPEVKFNWYVD GVEVHNAKTKPREEQYNSTYRVVSVLTVLHQDWL NGKEYKCKVSNKALPAPIEKTISKAKGQPREPQVYT LPPSRDELTKNQVSLTCLVKGFYPSDIAVEWESNGQ PENNYKTTPPVLDSDGSFFLYSKLTVDKSRWQQGN VFSCSVMHEALHNHYTQKSLSLSPGK |
| Mogamulizumab SEQ ID NO: 40 | CCR4 | Light chain | DVLMTQSPLSLPVTPGEPASISCRSSRNIVHINGDTY LEWYLQKPGQSPQLLIYKVSNRFSGVPDRFSGSGS GTDFTLKISRVEAEDVGVYYCFQGSLLPWTFGQGT KVEIKRTVAAPSVFIFPPSDEQLKSGTASVVCLLNNF YPREAKVQWKVDNALQSGNSQESVTEQDSKDSTY SLSSTLTLSKADYEKHKVYACEVTHQGLSSPVTKSFN RGEC |
| Varlilumab SEQ ID NO: 41 | CD27 | Heavy chain | QVQLVESGGGVVQPGRSLRLSCAASGFTFSSYDM HWVRQAPGKGLEWVAVIWYDGSNKYYADSVKGR FTISRDNSKNTLYLQMNSLRAEDTAVYYCARGSGN WGFFDYWGQGTLVTVSSASTKGPSVFPLAPSSKST SGGTAALGCLVKDYFPEPVTVSWNSGALTSGVHTF PAVLQSSGLYSLSSVVTVPSSSLGTQTYICNVNHKPS NTKVDKKVEPKSCDKTHTCPPCPAPELLGGPSVFLF PPKPKDTLMISRTPEVTCVVVDVSHEDPEVKFNWY VDGVEVHNAKTKPREEQYNSTYRVVSVLTVLHQD WLNGKEYKCKVSNKALPAPIEKTISKAKGQPREPQV YTLPPSRDELTKNQVSLTCLVKGFYPSDIAVEWESN GQPENNYKTTPPVLDSDGSFFLYSKLTVDKSRWQQ GNVFSCSVMHEALHNHYTQKSLSLSPGKGSS |
| Varlilumab SEQ ID NO: 42 | CD27 | Light chain | DIQMTQSPSSLSASVGDRVTITCRASQGISRWLAW YQQKPEKAPKSLIYAASSLQSGVPSRFSGSGSGTDF TLTISSLQPEDFATYYCQQYNTYPRTFGQGTKVEIKR TVAAPSVFIFPPSDEQLKSGTASVVCLLNNFYPREAK VQWKVDNALQSGNSQESVTEQDSKDSTYSLSSTLT LSKADYEKHKVYACEVTHQGLSSPVTKSFNRGEC |
| Ulocuplumab SEQ ID NO: 43 | CXCR4 | Heavy chain | EVQLVESGGGLVQPGGSLRLSCAAAGFTFSSYSMN WVRQAPGKGLEWVSYISSRSRTIYYADSVKGRFTIS RDNAKNSLYLQMNSLRDEDTAVYYCARDYGGQPP YYYYYGMDVWGQGTTVTVSSASTKGPSVFPLAPCS RSTSESTAALGCLVKDYFPEPVTVSWNSGALTSGV HTFPAVLQSSGLYSLSSVVTVPSSSLGTKTYTCNVD HKPSNTKVDKRVESKYGPPCPPCPAPEFLGGPSVFL FPPKPKDTLMISRTPEVTCVVVDVSQEDPEVQFNW YVDGVEVHNAKTKPREEQFNSTYRVVSVLTVLHQD |

TABLE 4-continued

| Antibody | Target | Description | Sequence |
|---|---|---|---|
| | | | WLNGKEYKCKVSNKGLPSSIEKTISKAKGQPREPQV YTLPPSQEEMTKNQVSLTCLVKGFYPSDIAVEWES NGQPENNYKTTPPVLDSDGSFFLYSRLTVDKSRWQ EGNVFSCSVMHEALHNHYTQKSLSLSLG |
| Ulocuplumab SEQ ID NO: 44 | CXCR4 | Light chain | DIQMTQSPSSLSASVGDRVTITCRASQGISSWLAW YQQKPEKAPKSLIYAASSLQSGVPSRFSGSGSGTDF TLTISSLQPEDFVTYYCQQYNSYPRTFGQGTKVEIKR TVAAPSVFIFPPSDEQLKSGTASVVCLLNNFYPREAK VQWKVDNALQSGNSQESVTEQDSKDSTYSLSSTLT LSKADYEKHKVYACEVTHQGLSSPVTKSFNRGEC |
| Bavituximab SEQ ID NO: 45 | Phosphatidyl Serine | Heavy chain | EVQLQQSGPELEKPGASVKLSCKASGYSFTGYNMN WVKQSHGKSLEWIGHIDPYYGDTSYNQKFRGKATL TVDKSSSTAYMQLKSLTSEDSAVYYCVKGGYYGHW YFDVWGAGTTVTVSSASTKGPSVFPLAPSSKSTSG GTAALGCLVKDYFPEPVTVSWNSGALTSGVHTFPA VLQSSGLYSLSSVVTVPSSSLGTQTYICNVNHKPSNT KVDKKVEPKSCDKTHTCPPCPAPELLGGPSVFLPPP KPKDTLMISRTPEVTCVVVDVSHEDPEVKFNWYVD GVEVHNAKTKPREEQYNSTYRVVSVLTVLHQDWL NGKEYKCKVSNKALPAPIEKTISKAKGQPREPQVYT LPPSRDELTKNQVSLTCLVKGFYPSDIAVEWESNGQ PENNYKTTPPVLDSDGSFFLYSKLTVDKSRWQQGN VFSCSVMHEALHNHYTQKSLSLSPGK |
| Bavituxumab SEQ ID NO: 46 | Phosphatidyl Serine | Light chain | TSSLDSGVPKRFSGSRSGSDYSLTISSLESEDFVDYYC LQYVSSPPTFGAGTKLELKRADAAPSVFIFPPSDEQL KSGTASVVCLLNNFYPREAKVQWKVDNALQSGNS QESVTEQDSKDSTYSLSSTLTLSKADYEKHKVYACEV THQGLSSPVTKSFNRGEC |

TABLE 5

Additional Checkpoint inhibitors

| Antibody | Target |
|---|---|
| MGN1703 (TLR9 agonist) | TLR9 |
| SHR-1210 (Incyte/Jiangsu Hengrui) | PD1 |
| OX40 (Agenus) | OX40 |
| PD1 (Agenus) | PD1 |
| Anti-Tim3 (Agenus/INcyte) | Tim3 |
| Anti-Lag3 (Agenus/INcyte) | Lag3 |
| Enoblituzumab (MGA-271) | B7H3 |
| CT-011 (hBAT, hBAT1) | As described in WO2009101611 |
| AMP-224 | PDL-2, described in WO2010027827 and WO2011066342 |
| CP-870, 893 | CD40 |
| CP-870, 893 | CD40 |
| REGN2810 | PD-1 |

In some embodiments, the single chain antibody is at least about 80%, at least about 85%, at least about 90%, at least about 95%, or at least about 99% homologous to the sequence of SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44 and/or SEQ ID NO:45.

Selected single chain antibody containing constructs, which may be generated according to the invention are included in Tables 3 and 4.

In some embodiments, genetically engineered bacteria comprise a nucleic acid sequence that encodes a polypeptide that is at least about 80%, at least about 85%, at least about 90%, at least about 95%, or at least about 99% homologous to the DNA sequence of SEQ ID NO: 1, SEQ ID NO: 2, SEQ ID NO: 3, and/or SEQ ID NO: 4.

Immuno-Metabolism and Metabolic Effectors

Tryptophan and Kynurenine

T regulatory cells, or Tregs, are a subpopulation of Tcells that modulate the immune system by preventing excessive immune reactions, maintaining tolerance to self-antigens, and abrogating autoimmunity. Tregs suppress the immune responses of other cells, for example, shutting down immune responses after they have successfully eliminated invading organisms. These cells generally suppress or downregulate induction and proliferation of effector T cells.

Tregs have been found to be up-regulated in individuals with cancer and are often recruited to the sites of many tumors. Studies in both humans and animal models suggest that high levels of Tregs in the tumor environment is indicative of a poor prognosis. Tregs are thought to suppress tumor immunity, hindering the body's innate ability to control the growth of cancerous cells.

There are different sub-populations of regulatory T cells, including those that express CD4, CD25, and Foxp3 (CD4+ CD25+ regulatory T cells). These "naturally-occurring" Tregs are different from helper T cells and are also distinguishable from "suppressor" T cell populations that are generated in vitro.

While regulatory T cells are crucial in mediating immune homeostasis and promoting the establishment and maintenance of peripheral tolerance, they are thought to contribute to the progress of many tumors. Most tumors elicit an immune response in the host that is mediated by tumor antigens, thus distinguishing the tumor from other non-cancerous cells. As cancer cells express both self- and tumor-associated antigens, Tregs are key to dampening effector Tcell responses, and therefore represent one of the main obstacles to effective anti-tumor response and the failure of current therapies that rely on induction or potentiation of anti-tumor responses. Thus, controlling the function of these Tregs cells in the tumor microenvironment without compromising peripheral tolerance represents a useful cancer therapy.

Tregs seem to be preferentially trafficked to the tumor microenvironment. While Tregs normally make only about 4% of CD4+ T Cells, they can make up as much as 20-30% of the total CD4+ population around the tumor microenvironment. It is widely recognized that the ratio of Tregs to Teffectors in the tumor microenvironment is a determining factor in the success the immune response against the cancer. High levels of Tregs in the tumor microenvironment are associated with poor prognosis in many cancers, such as ovarian, breast, renal, and pancreatic cancer, indicating that Tregs suppress Teffector cells and hinder the body's immune response against the cancer. Thus, in certain embodiments, the genetically engineered bacteria or genetically engineered oncolytic viruses of the present disclosure produce one or more anti-cancer molecules that deplete Tregs and/or inhibit or block the activation of Tregs.

The tryptophan (TRP) to kynurenine (KYN) metabolic pathway is established as a key regulator of innate and adaptive immunity. Several preclinical models suggest that this immune tolerance pathway is active in cancer immunity, autoimmunity, infection, transplant rejection, and allergy. Drugs targeting this pathway, e.g, indoleamine-2,3-dioxygenase (IDO), are in clinical trials with the aim at reversing cancer-induced immunosuppression.

The catabolism of the essential amino acid tryptophan is a central pathway maintaining the immunosuppressive microenvironment in many types of cancers. Tumor cells or myeloid cells in the tumor microenvironment express high levels of indoleamine-2,3-dioxygenase 1 (IDO1), which is the first and rate-limiting enzyme in the degradation of tryptophan. This enzymatic activity results in the depletion of tryptophan in the local microenvironment and subsequent inhibition of T cell responses, which results in immunosuppression (as T cells are particularly sensitive to low tryptophan levels). More recent preclinical studies suggest an alternative route of tryptophan degradation in tumors via the enzyme TRP-2,3-dioxygenase 2 (TDO). Thus, tumor cells may express and catabolize tryptophan via TDO instead of or in addition to IDO1.

In addition, several studies have proposed that immunosuppression by tryptophan degradation is not solely a consequence of lowering local tryptophan levels but also of accumulating high levels of tryptophan metabolites. Preclinical studies and analyses of human tumor tissue have demonstrated that T cell responses are inhibited by tryptophan metabolites, primarily by binding to the aryl hydrocarbon receptor (AHR), a cytoplasmic transcription factor. These studies show that binding of the tryptophan metabolite kynurenine to the aryl hydrocarbon receptor results in reprogramming the differentiation of naïve CD4+T-helper (Th) cells favoring a regulatory T cells phenotype (Treg) while suppressing the differentiation into interleukin-17 (IL-17)-producing Th (Th17) cells. Activation of the aryl hydrogen receptor also results in promoting a tolerogenic phenotype on dendritic cells.

In some embodiments, the genetically engineered microorganisms of the present disclosure, e.g., genetically engineered bacteria or genetically engineered oncolytic viruses are capable of depleting Tregs or inhibiting or blocking the avtivation of Tregs by producing tryptophan. In some embodiments, the genetically engineered microorganisms of the present disclosure capable of increasing the CD8+: Treg ratio (e.g., favors the production of CD8+ over Tregs) by producing tryptophan.

In some embodiments, the genetically engineered bacteria or genetically engineered oncolytic viruses that produce tryptophan comprise one or more gene sequences encoding one or more enzymes of the tryptophan biosynthetic pathway. In some embodiments, the genetically engineered bacteria genetically engineered oncolytic viruses comprise a tryptophan operon. In some embodiments, the genetically engineered bacteria or genetically engineered oncolytic viruses comprise the tryptophan operon of $E.$ $coli.$ (Yanofsky, RNA (2007), 13:1141-1154). In some embodiments, the genetically engineered bacteria or genetically engineered oncolytic viruses comprise the tryptophan operon of $B.$ $subtilis.$ (Yanofsky, RNA (2007), 13:1141-1154). In some embodiments, the genetically engineered bacteria or genetically engineered oncolytic viruses comprise sequence(s) encoding trypE, trypG-D, trypC-F, trypB, and trpA genes. In some embodiments, the genetically engineered bacteria or genetically engineered oncolytic viruses comprise sequence(s) encoding trypE, trypG-D, trypC-F, trypB, and trpA genes from $E.$ $coli.$ In some embodiments, the genetically engineered bacteria or genetically engineered oncolytic viruses comprise sequence(s) encoding trypE, trypD, trypC, trypF, trypB, and trpA genes. In some embodiments, the genetically engineered bacteria or genetically engineered oncolytic viruses comprise sequence (s) encoding trypE, trypD, trypC, trypF, trypB, and trpA genes from $B.$ $subtilis.$ In any of these embodiments, the tryptophan repressor (trpR) optionally may be deleted, mutated, or modified so as to diminish or obliterate its repressor function. Also, in any of these embodiments, the genetically engineered bacteria or genetically engineered oncolytic viruses optionally comprise gene sequence(s) to produce the tryptophan precursor, Chorismate. Thus, in some embodiments, the genetically engineered bacteria or genetically engineered oncolytic viruses optionally comprise sequence(s) encoding aroG, aroF, aroH, aroB, aroD, aroE, aroK, and AroC. In some embodiments, the genetically engineered bacteria or genetically engineered oncolytic viruses comprise one or more gene sequences encoding one or more enzymes of the tryptophan biosynthetic pathway and one or more gene sequences encoding one or more enzymes of the chorismate biosynthetic pathway. In some embodiments, the genetically engineered bacteria or genetically engineered oncolytic viruses comprise sequence(s) encoding trypE, trypG-D, trypC-F, trypB, and trpA genes from $E.$ $coli$ and sequence(s) encoding aroG, aroF, aroH, aroB, aroD, aroE, aroK, and AroC genes. In some embodiments, the genetically engineered bacteria or genetically engineered oncolytic viruses comprise sequence(s) encoding trypE, trypD, trypC, trypF, trypB, and trpA genes from $B.$ $subtilis$ and sequence(s) encoding aroG, aroF, aroH, aroB, aroD, aroE, aroK, and AroC genes. An exemplary bacterial strain encoding tryptophan biosynthetic genes is shown in FIG. 8A, FIG. 8B, FIG. 8C, FIG. 8D.

The inner membrane protein YddG of $Escherichia$ $coli,$ encoded by the yddG gene, is a homologue of the known amino acid exporters RhtA and YdeD. Studies have shown that YddG is capable of exporting aromatic amino acids, including tryptophan. Thus, YddG c an function as a tryptophan exporter or a tryptophan secretion system (or tryptophan secretion protein). Other aromatic amino acid exporters are described in Doroshenko et al., FEMS Microbial Lett., 275:312-318 (2007). Thus, in some embodiments, the engineered bacteria optionally further comprise gene sequence(s) encoding YddG. In some embodiments, the engineered bacteria can over-express YddG. In some embodiments, the engineered bacteria optionally comprise one or more copies of yddG gene.

As discussed above, studies have shown that the binding of kynurenine to the aryl hydrocarbon receptor results in the production of regulatory T cells (Tregs). Thus, in some embodiments, the genetically engineered bacteria or genetically engineered oncolytic viruses comprise a mechanism for metabolizing or degrading kyurenine. In some embodiments, the genetically engineered bacteria or genetically engineered oncolytic viruses comprise sequence encoding the enzyme kynureninase. Kynureninase is produced to metabolize Kynurenine to Anthranilic acid in the cell. Schwarcz et al., Nature Reviews Neuroscience, 13, 465-477; 2012; Chen & Guillemin, 2009; 2; 1-19; Intl. J. Tryptophan Res. Exemplary kynureninase sequences are provided herein below in Table 3. In some embodiments, the engineered microbe has a mechanism for importing (transporting) Kynurenine from the local environment into the cell. Thus, in some embodiments, the genetically engineered bacteria or genetically engineered oncolytic viruses comprise gene sequence(s) encoding a kynureninase secreter. In some embodiments, the genetically engineered bacteria or genetically engineered oncolytic viruses comprise one or more copies of aroP, tnaB or mtr gene.

Increasing Tryptophan

In some embodiments, the genetically engineered microorganisms, e.g., bacteria or oncolytic viruses, of the present disclosure are capable of producing tryptophan. Exemplary circuits for the production of tryptophan are shown in FIGS. 8A-8D, FIGS. 10A-10D, FIGS. 11A-11B, FIGS. 12A-12B, and FIG. 13.

In some embodiments, the genetically engineered bacteria and/or other microorganisms that produce tryptophan comprise one or more gene sequences encoding one or more enzymes of the tryptophan biosynthetic pathway. In some embodiments, the genetically engineered bacteria comprise a tryptophan operon. In some embodiments, the genetically engineered bacteria comprise the tryptophan operon of E. coli. (Yanofsky, RNA (2007), 13:1141-1154). In some embodiments, the genetically engineered bacteria comprise the tryptophan operon of B. subtilis. (Yanofsky, RNA (2007), 13:1141-1154). In some embodiments, the genetically engineered bacteria comprise sequence(s) encoding trypE, trypG-D, trypC-F, trypB, and trpA genes. In some embodiments, the genetically engineered bacteria comprise sequence(s) encoding trypE, trypG-D, trypC-F, trypB, and trpA genes from E. coli. In some embodiments, the genetically engineered bacteria comprise sequence(s) encoding trypE, trypD, trypC, trypF, trypB, and trpA genes from B. subtilis.

Also, in any of these embodiments, the genetically engineered bacteria and/or other microorganisms optionally comprise gene sequence(s) to produce the tryptophan precursor, chorismate. Thus, in some embodiments, the genetically engineered bacteria optionally comprise sequence(s) encoding aroG, aroF, aroH, aroB, aroD, aroE, aroK, and AroC. In some embodiments, the genetically engineered bacteria comprise one or more gene sequences encoding one or more enzymes of the tryptophan biosynthetic pathway and one or more gene sequences encoding one or more enzymes of the chorismate biosynthetic pathway. In some embodiments, the genetically engineered bacteria comprise sequence(s) encoding trypE, trypG-D, trypC-F, trypB, and trpA genes from E. coli and sequence(s) encoding aroG, aroF, aroH, aroB, aroD, aroE, aroK, and AroC genes. In some embodiments, the genetically engineered bacteria comprise sequence(s) encoding trypE, trypD, trypC, trypF, trypB, and trpA genes from B. subtilis and sequence(s) encoding aroG, aroF, aroH, aroB, aroD, aroE, aroK, and AroC genes.

In some embodiments, the genetically engineered bacteria comprise sequence(s) encoding either a wild type or a feedback resistant SerA gene (Table 86). Escherichia coli serA-encoded 3-phosphoglycerate (3PG) dehydrogenase catalyzes the first step of the major phosphorylated pathway of L-serine (Ser) biosynthesis. This step is an oxidation of 3PG to 3-phosphohydroxypyruvate (3PHP) with the concomitant reduction of NAD+ to NADH. As part of Tryptophan biosynthesis, E. coli uses one serine for each tryptophan produced. As a result, by expressing serA, tryptophan production is improved (see, e.g., FIG. 10A-FIG. 10D, FIG. 11A and FIG. 11B).

In any of these embodiments, AroG and TrpE are optionally replaced with feedback resistant versions to improve tryptophan production (Table 8).

In any of these embodiments, the tryptophan repressor (trpR) optionally may be deleted, mutated, or modified so as to diminish or obliterate its repressor function.

In any of these embodiments the tnaA gene (encoding a tryptophanase converting Trp into indole) optionally may be deleted to prevent tryptophan catabolism along this pathway and to further increase levels of tryptophan produced (Table 86).

The inner membrane protein YddG of Escherichia coli, encoded by the yddG gene, is a homologue of the known amino acid exporters RhtA and YdeD. Studies have shown that YddG is capable of exporting aromatic amino acids, including tryptophan. Thus, YddG can function as a tryptophan exporter or a tryptophan secretion system (or tryptophan secretion protein). Other aromatic amino acid exporters are described in Doroshenko et al., FEMS Microbial Lett., 275:312-318 (2007). Thus, in some embodiments, the engineered bacteria optionally further comprise gene sequence(s) encoding YddG. In some embodiments, the engineered bacteria can over-express YddG. In some embodiments, the engineered bacteria optionally comprise one or more copies of yddG gene.

Table 6 lists exemplary tryptophan synthesis cassettes encoded by the genetically engineered bacteria and/or other microorganisms of the disclosure.

TABLE 6

Tryptophan Synthesis Cassette Sequences

| Description | Sequence |
|---|---|
| Tet-regulated Tryptophan operon SEQ ID NO: 47 | Taagacccactttcacatttaagttgtttttctaatccgcatatgatcaattcaaggccgaataagaaggctggctc<br>tgcacccttggtgatcaaataattcgatagcttgtcgtaataatggcggcatactatcagtagtaggtgtttcccttc<br>ttctttagcgacttgatgctcttgatcttccaatacgcaacctaaagtaaaatgccccacagcgctgagtgcatata<br>atgcattctctagtgaaaaaccttgttggcataaaaaggctaattgattttcgagagtttcatactgtttttctgtagg<br>ccgtgtacctaaatgtactttttgctccatcgcgatgacttagtaaagcacatctaaaacttttagcgttattacgtaa<br>aaaatcttgccagctttccccttctaaagggcaaaagtgagtatggtgcctatctaacatctcaatggctaaggcg<br>tcgagcaaagcccgcttatttttttacatgccaatacaatgtaggctgctctacacctagcttctgggcgagtttacg<br>ggttgttaaaccttcgattccgacctcattaagcagctctaatgcgctgttaatcactttacttttatctaatctagaca<br>tcattaattcctaattttttgttgacactctatcattgatagagtttattttaccactccctatcagtgatagagaaaagtg<br>aactctagaaataattttgtttaactttaagaaggagatatacatatgcaaacacaaaaaccgactctcgaactgct<br>aacctgcgaaggcgcttatcgcgacaacccgactgcgcttttcaccagttgtgtggggatcgtccggcaacg<br>ctgctgctggaatccgcagatatcgacagcaaagatgatttaaaaagcctgctgctggtagacagtgcgctgc<br>gcattacagcattaagtgacactgtcacaatccaggcgcttccggcaatggagaagccctgttgacactactg<br>gataacgccttgcctgcgggtgtggaaaatgaacaatcaccaaactgccgcgtactgcgcttcccgcctgtca<br>gtccactgctggatgaagacgcccgcttatgctccctttcggtattgacgctttccgcttattacagaatctgttga<br>atgtaccgaaggaagaacgagaagcaatgttcttcggcggcctgttctcttatgaccttgtggcgggatttgaaa<br>atttaccgcaactgtcagcggaaaatagctgccctgatttctgatttatctcgctgaaacgctgatggtgattgac<br>catcagaaaaaaagcactcgtattcaggccagcctgtttgctccgaatgaagaagaaaaacaacgtctcactgc<br>tcgcctgaacgaactacgtcagcaactgaccgaagccgcgccgccgctgccggtggtttccgtgccgcatat<br>gcgttgtgaatgtaaccagagcgatgaagagttcggtggtgtagtgcgtttgttgcaaaaagcgattcgcgccg<br>gagaaattttccaggtggtgccatctcgccgtttctctctgccctgcccgtcaccgctggcagcctattacgtgct<br>gaaaaagagtaatcccagcccgtacatgattttatgcaggataatgatttcaccctgtttggcgcgtcgccggaa<br>agttcgctcaagtatgacgccaccagccgccagattgagatttacccgattgccggaacacgtccacgcggtc<br>gtcgtgccgatggttcgctggacagagacctcgacagccgcatcgaactggagatgcgtaccgatcataaag<br>agctttctgaacatctgatgctggtggatctcgcccgtaatgacctggcgcacgcatttgcacacccggcagccgc<br>tacgtcgccgatctcaccaaagttgaccgttactcttacgtgatgcacctagtctcccgcgttgttggtgagctgc<br>gccacgatctcgacgccctgcacgcttaccgcgcctgtatgaatatgggacgttaagcggtgcaccgaaagt<br>acgcgctatgcagttaattgccgaagcagaaggtcgtcgacgcggcagctacggcggcgcggtaggttatttt<br>accgcgcatggcgatctcgacacctgcattgtgatccgctcggcgctggtggaaaacggtatcgccaccgtgc<br>aagccggtgctggcgtagtcctttgattctgttccgcagtcggaacgcgacgaaactcgtaataaagcccgcgc<br>tgtactgcgcgctattgccaccgcgcatcatgcacaggagacgttctaatggctgacattctgctgctgataat<br>atcgactcttttacgtacaacctggcagatcagttgcgcagcaatggtcataacgtggtgatttaccgcaaccata<br>ttccggcgcagaccttaattgaacgcctggcgacgatgagcaatccggtgctgatgctttctcctggccccggt<br>gtgccgagcgaagccggttgtatgccggaactcctcacccgctcggtgccgaagctgccaattattggcatttg<br>cctcggacatcaggcgattgtcgaagcttacgggggctatgtcggtcaggcgggcgaaattcttcacgtaaa<br>gcgtcgagcattgaacatgacggtcaggcgatgtttgccggattaacaaacccgctgccagtggcgcgttatc<br>actcgctggttggcagtaacattccggccggtttaaccatcaacgcccattttaatggcatggtgatgcggtgc<br>gtcacgatgcagatcgcgtttggattccagttccatccggaatccattcttactacccagggcgctcgcctgct<br>ggaacaaacgctggcctgggcgcagcagaaactagagccaaccaacacgctgcaaccgattctggaaaaa<br>ctgtatcaggcacagacgcttagccaacaagaaagccaccagctgtttttcagcggtggtacgtggcgagctga<br>agccggaacaactggcggcggcgctggtgagcatgaaaattcgcggtgaacacccgaacgagatcgccgg<br>ggcagcaaccgcgctactggaaaacgccgcgccattcccgcgcccggattatctgtttgccgatatcgtcggt<br>actggcggtgacggcagcaacagcatcaatatttctaccgccagtgcgtttgtcgccgcggcctgcgggctga<br>aagtggcgaaacacggcaaccgtagcgtctccagtaaatccggctcgtcggatctgctggcggcgttcggtat<br>taatcttgatatgaacgccgataaatcgcgccaggcgctggatgagttaggcgtctgtttcctctttgcgccgaa<br>gtatcacaccggattccgccatgcgatgccggttcgccagcaactgaaaacccgcactctgttcaacgtgctg<br>ggaccattgattaacccggcgcatccgcgcgctggcgctaattggtgtttatagtccggaactggtgctgccgatt<br>gccgaaaccttgcgcgtgctggggtatcaacgcgcggcagtggtgcacagcggcgggatggatgaagtttc<br>attacacgcgccgacaatcgttgccgaactacatgacggcgaaattaagagctatcaattgaccgctgaagatt<br>ttggcctgacaccctaccaccaggagcaattggcaggcggaacaccggaagaaaaccgtgacattttaacac<br>gcttgttacaaggtaaaggcgacgccgcccatgaagcagccgtcgcgggcgaatgtcgccatgttaatgacgcct<br>gcatggccatgaagatctgcaagccaatgcgcaaaccgttcttgaggtactgcgcagtggttccgcttacgaca<br>gagtcaccgcactggcggcacgagggtaaatgatgcaaaccgtttagcgaaatcgtcgcagacaaggcg<br>atttgggtagaaacccgcaaagagcagcaaccgctggccagttttcagaatgaggttcagccgagcacgcga<br>cattttatgatgcacttcagggcgcacgcacggcgttattctggagctgtaaaaaagcgtcgccgtcaaaaggc<br>gtgatccgtgatgatttcgatccggcacgcattgccgcattttataaacattacgcttcggcaatttcagtgctgac<br>tgatgagaaatattttcagggagctttgatttcctccccatcgtcagccaaatcgccccgcagccgattttatgta<br>aagacttcattatcgatccttaccagatctatctggcgcgctattaccaggccgatgcctgcttattaatgctttcag<br>tactggatgacgaacaatatcgcagcttgcagccgtcgcccacagtctggagatgggtgtgctgaccgaagt<br>cagtaatgaagaggaactggagcgcgccattgcattgggggcaaaggtcgttggcatcaacaaccggatct<br>gcgcgatttgtcgattgatctcaaccgtacccgcgagcttgcgccgaaactggggcacaacgtgacggtaatc<br>agcgaatccggcatcaatacttacgctcaggtgcgcgagttaagccacttcgctaacggctttctgattggttcg<br>gcgttgatggccatgacgatttgaacgccgccgtgcgtgcgtgggtgtgctgggtgagaataaagtatgtggcct<br>gacacgtgggcaagatgctaaagcagcttatgacgcggcgcgatttacggtgggttgattttttgttgcgacat<br>caccgcgttgcgtcaacgttgaacaggcgcaggaagggatggctgcagcaccgttgcagtatgttggcgtgtt<br>ccgcaatcacgatattgccgatgtggcggacaaagctaaggtgttatcgctggcggcagtgcaactgcatggt<br>aatgaagatcagctgtatatcgacaatctgcctgaggcctgcacgcacacgtcgccatctggaaggctttaag<br>tgtcggtgaaactcttcccgcgcgcgatttcagcacatcgataaatatgtattcgacaacggtcagggcggga<br>gcggacaacgtttcgactggtcactattaaatggtcaatcgcttggcaacgttctgctggcgggggggcttaggc<br>gcagataactgcgtggaagcggcacaaaccggctgcgccgggcttgattttaattctgctgtagagtcgcaac<br>cgggtatcaaagacgcacgtcttttggcctcggttttccagacgctgcgcgcatattaaggaaaggaacaatga<br>caacattacttaaccccctattttggtgagtttggcggcatgtacgtgccacaaatcctgatgcctgctctgcgcca<br>gctggaagaagctttttgtcagcgcgcaaaaagatcctgaatttcaggctcagttcaacgacctgctgaaaaact<br>atgccgggcgtccaaccgcgctgaccaaatgccagaacattacagccgggacgaacaccacgctgtatctga<br>agcgcgaagatttgctgcacggcggcgcgcataaaaactaaccaggtgctcggtcaggctttactggcgaagc<br>ggatgggtaaaactgaaaattattgccgaaaccggtgccggtcagcatggcgtggcgtcggcccttgccagcg |

TABLE 6-continued

Tryptophan Synthesis Cassette Sequences

| Description | Sequence |
|---|---|
| | ccctgctcggcctgaaatgccgaatttatatgggtgccaaagacgttgaacgccagtcgcccaacgttttccgg<br>atgcgcttaatgggtgcggaagtgatcccggtacatagcggttccgcgaccctgaaagatgcctgtaatgagg<br>cgctacgcgactggtccggcagttatgaaaccgcgcactatatgctgggtaccgcagctggcccgcatcctta<br>cccgaccattgtgcgtgagtttcagcggatgattggcgaagaaacgaaagcgcagattctggaaagagaagg<br>tcgcctgccggatgccgttatcgcctgtgttggcggtggttcgaatgccatcggtatgtttgcagatttcatcaac<br>gaaaccgacgtcggcctgattggtgtggagcctggccggccacggtatcgaaactggcgagcacggcgcacc<br>gttaaaacatggtcgcgtgggcatctatttcggtatgaaagcgccgatgatgcaaaccgaagacgggcaaatt<br>gaagagtcttactccatttctgccgggctggatttcccgtccgtcggcccgcaacatgcgtatctcaacagcact<br>ggacgcgctgattacgtgtctattaccgacgatgaagccctggaagccttaaaacgctttgcctgcatgaagg<br>gatcatcccggcgctggaatcctcccacgccctggcccatgcgctgaaaatgatgcgcgaaaatccggaaaa<br>agagcagctactggtggttaacctttccggtcgcggcgataaagacatcttcaccgttcacgatattttgaaagc<br>acgaggggaaatctgatgaacgctacgaatctctgtttgcccagttgaaggagcgcaaagaaggcgcattc<br>gttcctttcgtcaccctcggtgatccggcattgagcagtcgttgaaaattatcgatacgctaattgaagccggtg<br>ctgacgcgctggagttaggcatcccctttctccgacccactggcggatggcccgacgattcaaaacgccacact<br>gcgtgcttttgcggcgggagtaaccccggcgcagtgctttgagatgctggcactcattcgccagaagcaccg<br>accattcccatcggccttttgatgtatgccaacctggtgtttaacaaaggcattgatgagtttatgccgagtgcga<br>gaaagtcggcgtcgattcggtgctggttgccgatgtgccccgtggaagagtccgcgccttccgccaggccgc<br>gttgcgtcataatgtcgcacctatctttatttgcccgccgaatgccgacgatgatttgctgcgccagatagcctctt<br>acggtcgtggttacacctatttgctgtcgcgagcgggcgtgaccggcgcagaaaaccgcgccgcgttacccc<br>tcaatcatctggttgcgaagctgaaagagtacaacgctgcgcctccattgcagggatttggtatttccgcccgg<br>atcaggtaaaagccgcgattgatgcaggagctgcgggcgcgatttctggttcggccatcgttaaaatcatcgag<br>caacatattaatgagccagagaaaatgctggcggcactgaaagcttttgtacaaccgatgaaagcggcgacgc<br>gcagttaatacgcatggcatggatgaCCGATGGTAGTGTGGGGTCTCCCCATGCG<br>AGAGTAGGGAACTGCCAGGCATCAAATAAAACGAAAGGCTCAGT<br>CGAAAGACTGGGCCTTTCGTTTTATCTGTTGTTTGTCGGTGAACGC<br>TCTCCTGAGTAGGACAAATCCGCCGGGAGCGGATTTGAACGTTGC<br>GAAGCAACGGCCCGGAGGGTGGCGGGCAGGACGCCCGCCATAAA<br>CTGCCAGGCATCAAATTAAGCAGAAGGCCATCCTGACGGATGGCC<br>TTTTTGCGTGGCCAGTGCCAAGCTTGCATGCGTGC |
| Tet repressor<br>SEQ ID<br>NO: 48 | taagacccactttcacatttaagttgttttctaatccgcatatgatcaattcaaggccgaataagaaggctggctct<br>gcacccttggtgatcaaataattcgatagcttgtcgtaataatggcggcatactatcagtagtaggtgtttcccttct<br>tctttagcgacttgatgctcttgatcttccaatacgcaacctaaagtaaaatgcccacagcgctgagtgcatata<br>atgcattctctagtgaaaaaccttgttggcataaaaaggctaattgattttcgagagtttcatactgttttttctgtagg<br>ccgtgtacctaaatgtacttttgctccatcgcgatgacttagtaaagcacatctaaaacttttagcgttattacgtaa<br>aaaatcttgccagctttccccttctaaagggcaaaagtgagtatggtgcctatctaacatctcaatggctaaggc<br>tcgagcaaagcccgcttatttttttacatgccaatacaatgtaggctgctctacacctagcttctgggcgagtttacg<br>ggttgttaaaaccttcgattccgacctcattaagcagctctaatgcgctgttaatcacttttacttttatctaatctagacat |
| tetR/tetA<br>promoters and<br>RBS and<br>leader region<br>SEQ ID NO<br>49: | cattaattcctaattttttgttgacactctatcattgatagagttattttaccactccctatcagtgatagagaaaagtga<br>actctagaaataattttgtttaactttaagaaggagatatacat |
| trpE<br>SEQ ID NO:<br>50 | atgcaaacacaaaaaccgactctcgaactgctaacctgcgaaggcgcttatcgcgacaacccgactgcgctttt<br>tcaccagttgtgtgggatcgtccggcaacgctgctgctggaatccgcagatatcgacagcaaagatgatttaa<br>aaagcctgctgctggtagacagtgcgctgcgcattacagcattaagtgacactgtcacaatccaggcgctttcc<br>ggcaatggagaagccctgttgacactactggataaagccttgcctgcgggtgtggaaaatgaacaatcaccaa<br>actgccgcgtactgcgcttcccgcctgtcagtccactgctggatgaagacgcccgcgcttatgctccctttcggttttt<br>tgacgctttccgcttattacagaatctgttgaatgtaccgaaggaagaacgagaagcaatgttcttcggcggcct<br>gttctcttatgaccttgtggcgggatttgaaaatttaccgcaactgtcagcggaaaatagctgccctgattctgttt<br>ttatctcgctgaaacgctgatggtgattgaccatcagaaaaaaagcactcgtattcaggccagcctgttttgctcc<br>gaatgaagaagaaaacgtctcactgctcgcctgaacgaactacgtcagcaactgaccgaagccggcgc<br>cgccgctgccggtggtttccgtgccgcatatgcgttgtgaatgtaaccagagcgatgaagagttcggtggtgta<br>gtgcgtttgttgcaaaagcgattcgcgccggagaaattttccaggtggtgccatctgccgttttctctctgccct<br>gcccgtcaccgctggcagcctattacgtgctgaaaaagagtaatcccagcccgtacatgttttttatgcaggata<br>atgatttcaccctgtttggcgcgtcgccggaaagttcgctcaagtatgacgccaccagccgcgccagattggagattt<br>accccgattgccggaacacgtccacgcggtcgtcgtgccgatggttcgctggacagagacctcgacagccgc<br>atcgaactggagatgcgtaccgatcataaagagctttctgaacatctgatgctggtggatctcgcccgtaatgac<br>ctggcacgcatttgcacacccggcagccgctacgtcgccgatctcaccaaagttgaccgttactcttacgtgat<br>gcacctagtctcccgcgttgttggtgagctgcgccaagatctcgacgccctgcacgcttaccgcgcctgtatga<br>atatgggacgttaagcggtgcaccgaaagtacgcgctatgcagttaattgccgaagcagaaggtcgtcgac<br>gcggcagctacggcggcgcggtaggttatttaccgcgcatggcgatctcgacacctgcattgtgatccgctc<br>ggcgctggtggaaaacggtatcgccaccgtgcaagccggtgctggcgtagtccttgattctgttccgcagtcg<br>gaagccgacgaaactcgtaataaagcccgcgctgtactgcgcgctattgccaccgcgcatcatgcacaggag<br>acgttcta |
| trpD<br>SEQ ID NO:<br>51 | atggctgacattctgctgctcgataatatcgactcttttacgtacaacctggcagatcagttgcgcagcaatggtc<br>ataacgtggtgatttaccgcaaccatattccggcgcagacctttaattgaacgcctggccgacgatgagcaatccg<br>gtgctgatgctttctcctggccccggtgtgccgagcgaagccggttgtatgcgggaactcctcaccgcttgcg<br>tggcaagctgccaattattggcatttgcctcggacatcaggcgattgtcgaagcttacgggggctatgtcggtca<br>ggcgggcgaaattcttcacggtaaagcgtcgagcattgaacatgacggtcaggcgatgtttgccggattaaca<br>aaccgctgccagtggcgcgttatcactcgctggttggcagtaacattccggccggtttaaccatcaacgccca<br>ttttaatggcatggtgatggcggtgcgtcacgatgcagatcgcgtttgtggattccagttccatccggaatccatt |

TABLE 6-continued

Tryptophan Synthesis Cassette Sequences

| Description | Sequence |
|---|---|
| | cttactacccagggcgctcgcctgctggaacaaacgctggcctgggcgcagcagaaactagagccaaccaa<br>cacgctgcaaccgattctggaaaaactgtatcaggcacagacgcttagccaacaagaaagccaccagctgttt<br>tcagcggtggtacgtggcgagctgaagccggaacaactggcggcggcgctggtgagcatgaaaattcgcgg<br>tgaacacccgaacgagatcgccggggcagcaaccgcgctactggaaaacgccgcgccattcccgcgccg<br>gattatctgtttgccgatatcgtcggtactggcggtgacggcagcaacagcatcaatatttctaccgccagtgcg<br>tttgtcgccgcggcctgcgggctgaaagtggcgaaacacggcaaccgtagcgtctccagtaaatccggctcg<br>tcggatctgctggcggcgttcggtattaatcttgatatgaacgccgataaatcgcgccaggcgctggatgagtta<br>ggcgtctgtttcctctttgcgccgaagtatcacaccggattccgccatgcgatgccggttcgccagcaactgaa<br>aacccgcactctgttcaacgtgctgggaccattgattaacccgcgcatccgccgctggcgctaattggtgttta<br>tagtccggaactggtgctgccgattgccgaaaccttgcgcgtgctggggtatcaacgcgcggcagtggtgca<br>cagccggcggatggatgaagtttcattacacgcgccgacaatcgttgccgaactacatgacggcgaaattaag<br>agctatcaattgaccgctgaagattttggcctgacaccctaccaccaggagcaattggcaggcggaacaccgg<br>aagaaaaccgtgacattttaacacgcttgttacaaggtaaaggcgacgccgcccatgaagcagccgtcgcgg<br>cgaatgtcgccatgttaatgcgcctgcatggccatgaagatctgcaagccaatgcgcaaaccgttcttgaggta<br>ctgcgcagtggttccgcttacgacagagtcaccgcactggcggcacgagggtaa |
| trpC<br>SEQ ID NO:<br>52 | atgcaaaccgttttagcgaaaatcgtcgcagacaaggcgatttgggtagaaacccgcaaagagcagcaaccg<br>ctggccagttttcagaatgaggttcagccgagcacgcgacattttatgatgcacttcagggcgcacgcacggc<br>gtttattctggagtgtaaaaagcgtcgccgtcaaaaggcgtgatccgtgatgattcgatccggcacgcattgc<br>cgccattatataaacattacgcttcggcaatttcagtgctgactgatgagaaatattcaggggagctttgatttcct<br>ccccatcgtcagccaaatcgccccgcagccgatttatgtaaagacttcattatcgatccttaccagatctatctg<br>gcgcgctattaccaggccgatgcctgcttattaatgctttcagtactggatgacgaacaatatcgccagcttgca<br>gccgtcgcccacagtctggagatgggtgtgctgaccgaagtcagtaatgaagaggaactggagcgcgccatt<br>gcattgggggcaaaggtcgttggcatcaacaaccgcgatctgcgcgatttgtcgattgatctcaaccgtacccg<br>cgagcttgcgccgaaactggggcacaacgtgacggtaatcacgcgaatccggcatcaatacttacgctcaggt<br>gcgcgagttaagccacttcgctaacggctttctgattggttcggcgttgatggcccatgacgatttgaacgccgc<br>cgtgcgtcgggtgttgctgggtgagaataaagtatgtggcctgacacgtgggcaagatgctaaagcagcttat<br>gacgcgggcgcgatttacggtgggttgattttttgttgcgacatcaccgcgttgcgtcaacgttgaacaggcgca<br>ggaagtgatggctgcagcaccgttgcagtatgttggcgtgttccgcaatcacgatattgccgatgtggcggaca<br>agctaaggtgttatcgctggcggcagtgcaactgcatggtaatgaagatcagctgtatatcgacaatctgcgt<br>gaggctctgccagcacacgtcgccatctggaaggctttaagtgtcggtgaaactcttcccgcgcgcgattttca<br>gcacatcgataaatatgtattcgacaacggtcagggcgggacgacaacgtttcgactggtcactattaaatg<br>gtcaatcgcttggcaacgttctgctggcggggggcttaggcgcagataactgcgtggaagcggcacaaaccg<br>gctgcgccgggcttgattttaattctgctgtagagtcgcaacggggtatcaaagacgcacgtcttttggcctcggt<br>tttccagacgctgcgcgcatattaa |
| trpB<br>SEQ ID NO:<br>53 | atgacaacattacttaaccctatttggtgagtttggcggcatgtacgtgccacaaatcctgatgcctgctctgcg<br>ccagctggaagaagcttttgtcagcgcgcaaaaagatcctgaatttcaggctcagttcaacgacctgctgaaaa<br>actatgccgggcgtccaaccgcgctgaccaaatgccagaacattacagccgggacgaacaccacgctgatc<br>tgaagcgcgaagatttgctgcacggcggcgcgcataaaactaaccaggtgctcggtcaggctttactggcga<br>agcggatgggtaaaactgaaattattgccgaaaccggtgccggtcagcatggcgtggcgtcggcccttgcca<br>gcgccctgctcggcctgaaatgccgaatttatatgggtgccaaagacgttgaacgccagtcgcccaacgttttc<br>cggatgcgcttaatgggtgcggaagtgatcccggtacatagcggttccgcgaccctgaaagatgcctgtaatg<br>aggcgctacgcgactggtccggcagttatgaaaccgcgcactatatgctgggtaccgcagctggcccgcatc<br>cttacccgaccattgtgcgtgagtttcagccggatgattggcgaagaaacgaaagcgcagattctggaaagaga<br>aggtcgcctgccggatgccgttatcgccgtgttggcggtggttcgaatgccatcggtatgtttgcagatttcatc<br>aacgaaaccgacgtcggcctgattggtgtggagcctggcggccacggtatcgaactggcgagcacggcgc<br>accgttaaaacatggtcgcgtgggcatctatttcggtatgaaagcgccgatgatgcaaaccgaagacgggcaa<br>attgaagagtcttactccatttctgccgggctggatttcccgtccgtcggcccgcaacatgcgtatctcaacagc<br>actggacgcgctgattacgtgtctattaccgacgatgaagccctggaagccttaaaacgctttgcctgcatgaa<br>gggatcatcccggcgctggaatcctcccacgccctggcccatgcgctgaaaatgatgcgcgaaaatccggaa<br>aaagagcagctactggtggttaacctttccggtcgcggcgataaagacatcttcaccgttcacgatattttgaaa<br>gcacgaggggaaatctga |
| trpA<br>SEQ ID NO:<br>54 | atggaacgctacgaatctctgtttgcccagttgaaggagcgcaaagaaggcgcattcgttcctttcgtcaccctc<br>ggtgatccgggcattgagcagtcgttgaaaattatcgatacgctaattgaagcggtgctgacgcgctggagtt<br>aggcatcccttctccgacccactggcggatggcccgacgattcaaaacgccacactgcgtgcttttgcggcg<br>ggagtaaccccggcgcagtgctttgagatgctggcactcattcgccagaagcacccgaccattcccatcggcc<br>ttttgatgtatgccaacctggtgtttaacaaaggcattgatgagttttatgccgagtgcgagaaagtcggcgtcga<br>ttcggtgctggttgccgatgtgcccgtggaagagtccgcgccctccgccaggccgcgttgcgtcataatgtcg<br>cacctatctttatttgcccgccgaatgccgacgatttgctgcgccagatagcctcttacggctggttacac<br>ctatttgctgtcgcgagcgggcgtgaccggcgcagaaaccgccgcgcgttaccccctcaatcatctggttgcg<br>aagctgaaagagtacaacgctgcgcctccattgcagggatttggtatttccgccccggatcaggtaaaagccg<br>cgattgatgcaggagctgcgggcgcgatttctggttcggccatcgttaaaatcatcgagcaacatattaatgagc<br>cagagaaaatgctggcggcactgaaagcttttgtacaaccgatgaaagcggcgacgcgcagttaa |

TABLE 7

Exemplary Tryptophan Biosynthesis Enzymes

| Description | Sequence |
|---|---|
| TrpE SEQ ID NO: 55 | MQTQKPTLELLTCEGAYRDNPTALFHQLCGDRPATLLLESADIDSKD DLKSLLLVDSALRITALSDTVTIQALSGNGEALLTLLDNALPAGVENE QSPNCRVLRFPPVSPLLDEDARLCSLSVFDAFRLLQNLLNVPKEEREA MFFGGLFSYDLVAGFENLPQLSAENSCPDFCFYLAETLMVIDHQKKST RIQASLFAPNEEEKQRLTARLNELRQQLTEAAPPLPVVSVPHMRCECN QSDEEFGGVVRLLQKAIRAGEIFQVVPSRRFSLPCPSPLAAYYVLKKS NPSPYMFFMQDNDFTLFGASPESSLKYDATSRQIEIYPIAGTRPRGRRA DGSLDRDLDSRIELEMRTDHKELSEHLMLVDLARNDLARICTPGSRY VADLTKVDRYSYVMHLVSRVVGELRHDLDALHAYRACMNMGTLSG APKVRAMQLIAEAEGRRRGSYGGAVGYFTAHGDLDTCIVIRSALVEN GIATVQAGAGVVLDSVPQSEADETRNKARAVLRAIATAHHAQETF |
| TrpD SEQ ID NO: 56 | MADILLLDNIDSFTYNLADQLRSNGHNVVIYRNHIPAQTLIERLATMS NPVLMLSPGPGVPSEAGCMPELLTRLRGKLPIIGICLGHQAIVEAYGG YVGQAGEILHGKASSIEHDGQAMFAGLTNPLPVARYHSLVGSNIPAG LTINAHFNGMVMAVRHDADRVCGFQFHPESILTTQGARLLEQTLAW AQQKLEPTNTLQPILEKLYQAQTLSQQESHQLFSAVVRGELKPEQLAA ALVSMKIRGEHPNEIAGAATALLENAAPFPRPDYLFADIVGTGGDGSN SINISTASAFVAAACGLKVAKHGNRSVSSKSGSSDLLAAFGINLDMNA DKSRQALDELGVCFLFAPKYHTGFRHAMPVRQQLKTRTLFNVLGPLI NPAHPPLALIGVYSPELVLPIAETLRVLGYQRAAVVHSGGMDEVSLH APTIVAELHDGEIKSYQLTAEDFGLTPYHQEQLAGGTPEENRDILTRLL QGKGDAAHEAAVAANVAMLMRLHGHEDLQANAQTVLEVLRSGSA YDRVTALAARG |
| TrpC SEQ ID NO: 57 | MQTVLAKIVADKAIWVETRKEQQPLASFQNEVQPSTRHFYDALQGA RTAFILECKKASPSKGVIRDDFDPARIAAIYKHYASAISVLTDEKYFQG SFDFLPIVSQIAPQPILCKDFIIDPYQIYLARYYQADACLLMLSVLDDEQ YRQLAAVAHSLEMGVLTEVSNEEELERAIALGAKVVGINNRDLRDLS IDLNRTRELAPKLGHNVTVISESGINTYAQVRELSHFANGFLIGSALM AHDDLNAAVRRVLLGENKVCGLTRGQDAKAAYDAGAIYGGLIFVAT SPRCVNVEQAQEVMAAAPLQYVGVFRNHDIADVADKAKVLSLAAV QLHGNEDQLYIDNLREALPAHVAIWKALSVGETLPARDFQHIDKYVF DNGQGGSGQRFDWSLLNGQSLGNVLLAGGLGADNCVEAAQTGCAG LDFNSAVESQPGIKDARLLASVFQTLRAY |
| TrpB SEQ ID NO: 58 | MTTLLNPYFGEFGGMYVPQILMPALRQLEEAFVSAQKDPEFQAQFND LLKNYAGRPTALTKCQNITAGTNTTLYLKREDLLHGGAHKTNQVLG QALLAKRMGKTEIIAETGAGQHGVASALASALLGLKCRIYMGAKDV ERQSPNVFRMRLMGAEVIPVHSGSATLKDACNEALRDWSGSYETAH YMLGTAAGPHPYPTIVREFQRMIGEETKAQILEREGRLPDAVIACVGG GSNAIGMFADFINETDVGLIGVEPGGHGIETGEHGAPLKHGRVGIYFG MKAPMMQTEDGQIEESYSISAGLDFPSVGPQHAYLNSTGRADYVSIT DDEALEAFKTLCLHEGIIPALESSHALAHALKMMRENPEKEQLLVVN LSGRGDKDIFTVHDILKARGEI |
| TrpA SEQ ID NO: 59 | MERYESLFAQLKERKEGAFVPFVTLGDPGIEQSLKIIDTLIEAGADALE LGIPFSDPLADGPTIQNATLRAFAAGVTPAQCFEMLALIRQKHPTIPIGL LMYANLVFNKGIDEFYAECEKVGVDSVLVADVPVEESAPFRQAALR HNVAPIFICPPNADDDLLRQIASYGRGYTYLLSRAGVTGAENRAALPL NHLVAKLKEYNAAPPLQGFGISAPDQVKAAIDAGAAGAISGSAIVKII EQHINEPEKMLAALKAFVQPMKAATRS |

In some embodiments, the tryptophan biosynthesis enzyme or cassette is at least about 80%, at least about 85%, at least about 90%, at least about 95%, or at least about 99% homologous to the sequence of SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, and/or SEQ ID NO: 59.

In some embodiments, the genetically engineered bacteria and/or other microorganisms comprise one or more nucleic acid sequence of Table 6 or a functional fragment thereof. In some embodiments, the genetically engineered bacteria comprise a nucleic acid sequence that, but for the redundancy of the genetic code, encodes the same polypeptide as one or more nucleic acid sequence of Table 6 or a functional fragment thereof. In some embodiments, genetically engineered bacteria comprise a nucleic acid sequence that is at least about 80%, at least about 85%, at least about 90%, at least about 95%, or at least about 99% homologous to the DNA sequence of one or more nucleic acid sequence of Table 6 or a functional fragment thereof, or a nucleic acid sequence that, but for the redundancy of the genetic code, encodes the same polypeptide as one or more nucleic acid sequence of Table 6 or a functional fragment thereof.

Accordingly, in one embodiment, one or more polypeptides and/or polynucleotides expressed by the genetically engineered bacteria have at least about 80%, 81%, 82%, 83%, 84%, 85%, 86%, 87%, 88%, 89%, 90%, 91%, 92%, 93%, 94%, 95%, 96%, 97%, 98%, or 99% identity with one or more of SEQ ID NO: 47 through SEQ ID NO: 59. In another embodiment, one or more polynucleotides and/or polypeptides encoded and expressed by the genetically engineered bacteria comprise the sequence of one or more of SEQ ID NO: 47 through SEQ ID NO: 59. In another embodiment, one or more polynucleotides and/or polypeptides encoded and expressed by the genetically engineered bacteria consist of the sequence of one or more of SEQ ID NO: 47 through SEQ ID NO: 59.

Table 8 depicts exemplary polypeptide sequences feedback resistant AroG and TrpE. Table 8 also depicts an exemplary TnaA (tryptophanase from *E. coli*) sequence. IN some embodiments, the sequence is encoded in circuits for tryptophan catabolism to indole; in other embodiments, the sequence is deleted from the *E coli* chromosome to increase levels of tryptophan.

60 through SEQ ID NO: 63. In one embodiment, one or more polypeptides encoded and expressed by the genetically engineered bacteria have at least about 85% identity with one or more of SEQ ID NO: 60 through SEQ ID NO: 63. In one embodiment, one or more polypeptides encoded and expressed by the genetically engineered bacteria have at least about 90% identity with one or more of SEQ ID NO: 60 through SEQ ID NO: 63. In one embodiment, one or more polypeptides and/or polynucleotides encoded and

TABLE 8

Feedback resistant AroG and TrpE and tryptophanase sequences

| Description | Sequence |
| --- | --- |
| AroGfbr: feedback resistant 2-dehydro-3-deoxyphosphoheptonate aldolase from *E. coli* SEQ ID NO: 60 | MNYQNDDLRIKEIKELLPPVALLEKFPATENAANTVAHARKAI HKILKGNDDRLLVVIGPCSIHDPVAAKEYATRLLTLREELQDE LEIVMRVYFEKPRTTVGWKGLINDPHMDNSFQINDGLRIARK LLLDINDSGLPAAGEFLDMITLQYLADLMSWGAIGARTTESQ VHRELASGLSCPVGFKNGTDGTIKVAIDAINAAGAPHCFLSVT KWGHSAIVNTSGNGDCHIILRGGKEPNYSAKHVAEVKEGLNK AGLPAQVMIDFSHANSSKQFKKQMDVCTDVCQQIAGGEKAII GVMVESHLVEGNQSLESGEPLAYGKSITDACIGWDDTDALLR QLASAVKARRG |
| TrpEfbr: feedback resistant anthranilate synthase component I from *E. coli* SEQ ID NO: 61 | MQTQKPTLELLTCEGAYRDNPTALFHQLCGDRPATLLLEFADI DSKDDLKSLLLVDSALRITALSDTVTIQALSGNGEALLTLLDN ALPAGVENEQSPNCRVLRFPPVSPLLDEDARLCSLSVFDAFRL LQNLLNVPKEEREAMFFGGLFSYDLVAGFENLPQLSAENSCP DFCFYLAETLMVIDHQKKSTRIQASLFAPNEEEKQRLTARLNE LRQQLTEAAPPLPVVSVPHMRCECNQSDEEFGGVVRLLQKAI RAGEIFQVVPSRRFSLPCPSPLAAYYVLKKSNPSPYMFFMQDN DFTLFGASPESSLKYDATSRQIEIYPIAGTRPRGRRADGSLDRD LDSRIELEMRTDHKELSEHLMLVDLARNDLARICTPGSRYVA DLTKVDRYSYVMHLVSRVVGELRHDLDALHAYRACMNMGT LSGAPKVRAMQLIAEAEGRRRGSYGGAVGYFTAHGDLDTCIV IRSALVENGIATVQAGAGVVLDSVPQSEADETRNKARAVLRA IATAHHAQETF |
| SerA: 2-oxoglutarate reductase from *E. coli* Nissle SEQ ID NO: 62 | MAKVSLEKDKIKFLLVEGVHQKALESLRAAGYTNIEFHKGAL DDEQLKESIRDAHFIGLRSRTHLTEDVINAAEKLVAIGCFCIGT NQVDLDAAAKRGIPVFNAPFSNTRSVAELVIGELLLLLRGVPE ANAKAHRGVWNKLAAGSFEARGKKLGIIGYGHIGTQLGILAE SLGMYVYFYDIENKLPLGNATQVQHLSDLLNMSDVVSLHVPE NPSTKNMMGAKEISLMKPGSLLINASRGTVVDIPALCDALASK HLAGAAIDVFPTEPATNSDPFTSPLCEFDNVLLTPHIGGSTQEA QENIGLEVAGKLIKYSDNGSTLSAVNFPEVSLPLHGGRRLMHI HENRPGVLTALNKIFAEQGVNIAAQYLQTSAQMGYVVIDIEA DEDVAEKALQAMKAIPGTIRARLLY |
| SerAfbr: feedback resistant 2-oxoglutarate reductase from *E. coli* Nissle SEQ ID NO: 63 | MAKVSLEKDKIKFLLVEGVHQKALESLRAAGYTNIEFHKGAL DDEQLKESIRDAHFIGLRSRTHLTEDVINAAEKLVAIGCFCIGT NQVDLDAAAKRGIPVFNAPFSNTRSVAELVIGELLLLLRGVPE ANAKAHRGVWNKLAAGSFEARGKKLGIIGYGHIGTQLGILAE SLGMYVYFYDIENKLPLGNATQVQHLSDLLNMSDVVSLHVPE NPSTKNMMGAKEISLMKPGSLLINASRGTVVDIPALCDALASK HLAGAAIDVFPTEPATNSDPFTSPLCEFDNVLLTPHIGGSTQEA QENIGLEVAGKLIKYSDNGSTLSAVNFPEVSLPLHGGRRLMHI AEARPGVLTALNKIFAEQGVNIAAQYLQTSAQMGYVVIDIEA DEDVAEKALQAMKAIPGTIRARLLY |
| TnaA: tryptophanase from *E. coli* SEQ ID NO: 64 | MENFKHLPEPFRIRVIEPVKRTTRAYREEAIIKSGMNPFLLDSE DVFIDLLTDSGTGAVTQSMQAAMMRGDEAYSGSRSYYALAE SVKNIFGYQYTIPTHQGRGAEQIYIPVLIKKREQEKGLDRSKM VAFSNYFFDTTQGHSQINGCTVRNVYIKEAFDTGVRYDFKGN FDLEGLERGIEEVGPNNVPYIVATITSNSAGGQPVSLANLKVM YSIAKKYDIPVVMDSARFAENAYFIKQREAEYKDWTIEQITRE TYKYADMLAMSAKKDAMVPMGGLLCMKDDSFFDVYTECRT LCVVQEGFPTYGGLEGGAMERLAVGLYDGMNLDWLAYRIA QVQYLVDGLEEIGVVCQQAGGHAAFVDAGKLLPHIPADQFPA QALACELYKVAGIRAVEIGSFLLGRDPKTGKQLPCPAELLRLTI PRATYTQTHMDFIIEAFKHVKENAANIKGLTFTYEPKVLRHFT AKLKEV |

In one embodiment, one or more polypeptides encoded and expressed by the genetically engineered bacteria have at least about 80% identity with one or more of SEQ ID NO: expressed by the genetically engineered bacteria have at least about 95% identity with one or more of SEQ ID NO: 60 through SEQ ID NO: 63. In one embodiment, one or more polypeptides and/or polynucleotides encoded and expressed by the genetically engineered bacteria have have at least about 96%, 97%, 98%, or 99% identity with one or more of SEQ ID NO: 60 through SEQ ID NO: 63. Accordingly, in one embodiment, one or more polypeptides expressed by the genetically engineered bacteria have at least about 80%, 81%, 82%, 83%, 84%, 85%, 86%, 87%, 88%, 89%, 90%, 91%, 92%, 93%, 94%, 95%, 96%, 97%, 98%, or 99% identity with one or more of SEQ ID NO: 60 through SEQ ID NO: 63. In another embodiment, one or more polynucleotides and/or polypeptides encoded and expressed by the genetically engineered bacteria comprise the sequence of one or more of SEQ ID NO: 60 through SEQ ID NO: 63. In another embodiment, one or more polypeptides encoded and expressed by the genetically engineered bacteria consist of the sequence of one or more of SEQ ID NO: 60 through SEQ ID NO: 63.

In some embodiments, the endogenous TnaA polypeptide comprising SEQ ID NO: 64 is mutated or deleted.

In some embodiments, one or more genes for producing tryptophan are modified and/or mutated, e.g., to enhance stability, increase tryptophan production.

In some embodiments, the genetically engineered bacteria are capable of expressing any one or more of the described circuits in low-oxygen conditions, and/or in the presence of cancer and/or the tumor microenvironment and/or the tumor microenvironment or tissue specific molecules or metabolites, and/or in the presence of molecules or metabolites associated with inflammation or immune suppression, and/or in the presence of metabolites that may be present in the gut, and/or in the presence of metabolites that may or may not be present in vivo, and may be present in vitro during strain culture, expansion, production and/or manufacture, such as arabinose and others described herein. In some embodiments, the gene sequences(s) are controlled by a promoter inducible by such conditions and/or inducers. In some embodiments, the gene sequences(s) are controlled by a constitutive promoter, as described herein. In some embodiments, the gene sequences(s) are controlled by a constitutive promoter, and are expressed in in vivo conditions and/or in vitro conditions, e.g., during bacterial expansion, production and/or manufacture, as described herein.

In some embodiments, any one or more of the described circuits are present on one or more plasmids (e.g., high copy or low copy) or are integrated into one or more sites in the bacterial chromosome. Also, in some embodiments, the genetically engineered bacteria and/or other microorganisms are further capable of expressing any one or more of the described circuits and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, (6) one or more surface display circuits, such as any of the surface display circuits described herein and otherwise known in the art and (7) one or more circuits for the production or degradation of one or more metabolites (e.g., kynurenine, tryptophan, adenosine, arginine) described herein and (8) combinations of one or more of such additional circuits.

Decreasing Kynurenine

In some embodiments, the genetically engineered bacteria and/or other microorganisms comprise a mechanism for metabolizing or degrading kynurenine, and reducing kynurenine levels in the extracellular environment. In some embodiments, the genetically engineered bacteria and/or other microorganisms comprise gene sequence(s) encoding kynureninase. e.g., kynureninase from *Pseudomonas fluorescens*, which converts kynurenine to AA (Anthranillic acid), which then can be converted to tryptophan through the enzymes of the *E. coli* trp operon. Optionally, the trpE gene may be deleted as it is not needed for the generation of tryptophan from kynurenine. Accordingly, in one embodiment, the genetically engineered bacteria may comprise one or more gene(s) or gene cassette(s) encoding trpD, trpC, trpA, and trpD and kynureninase (see, e.g. FIG. 13). This deletion may prevent tryptophan production through the endogenous chorismate pathway, and may increase the production of tryptophan from kynurenine through kynureninase.

In alternate embodiments, the trpE gene is not deleted, in order to maximize tryptophan production by using both kynurenine and chorismate as a substrate. In one embodiment of the invention, the genetically engineered bacteria and/or other microorganisms comprising this circuit may be useful for reducing immune escape in cancer. In some embodiments, the microorganisms encode a transporter for the uptake of kynurenine from the extracellular environment, e.g., the tumor environment. AroT, located between chr and the trp operon in *Salmonella typhimurium*, and similar genes, aroR and aroS, near the trp locus of *Escherichia coli*, were found to be involved in the transport of aromatic amino acids. AroP is a permease that is involved in the transport across the cytoplasmic membrane of the aromatic amino acids (phenylalanine, tyrosine, and tryptophan). Expression of such transporters/premises may be useful for kynurenine import in the genetically engineered microorganisms.

Table 9 lists exemplary genes encoding kynureninase which are encoded by the genetically engineered bacteria of the disclosure in certain embodiments.

TABLE 9

| Kynureninase protein sequences | | |
|---|---|---|
| Description | ID | Sequence |
| *Pseudomonas* kynureninase SEQ ID NO: 65 | P83788 | MTTRNDCLALDAQDSLAPLRQQFALPEGVIYLDGNS LGARPVAALARAQAVIAEEWGNGLIRSWNSAGWRD LSERLGNRLATLIGARDGEVVVTDTTSINLFKVLSAA LRVQATRSPERRVIVTETSNFPTDLYIAEGLADMLQQ GYTLRLVDSPEELPQAIDQDTAVVMLTHVNYKTGYM HDMQALTALSHECGALAIWDLAHSAGAVPVDLHQA GADYAIGCTYKYLNGGPGSQAFVWVSPQLCDLVPQP LSGWFGHSRQFAMEPRYEPSNGIARYLCGTQPITSLA MVECGLDVFAQTDMASLRRKSLALTDLFIELVEQRC |

TABLE 9-continued

Kynureninase protein sequences

| Description | ID | Sequence |
|---|---|---|
| | | AAHELTLVTPREHAKRGSHVSFEHPEGYAVIQALIDR<br>GVIGDYREPRIMRFGFTPLYTTFTEVWDAVQILGEILD<br>RKTWAQAQFQVRHSVT* |
| Human<br>SEQ ID NO:<br>66 | Q16719 | MEPSSLELPADTVQRIAAELKCHPTDERVALHLDEED<br>KLRHFRECFYIPKIQDLPPVDLSLVNKDENAIYFLGNS<br>LGLQPKMVKTYLEEELDKWAKIAAYGHEVGKRPWI<br>TGDESIVGLMKDIVGANEKEIALMNALTVNLHLLML<br>SFFKPTPKRYKILLEAKAFPSDHYAIESQLQLHGLNIE<br>ESMRMIKPREGEETLRIEDILEVIEKEGDSIAVILFSGV<br>HFYTGQHFNIPAITKAGQAKGCYVGFDLAHAVGNVE<br>LYLHDWGVDFACWCSYKYLNAGAGGIAGAFIHEKH<br>AHTIKPALVGWFGHELSTRFKMDNKLQLIPGVCGFRI<br>SNPPILLVCSLHASLEIFKQATMKALRKKSVLLTGYLE<br>YLIKHNYGKDKAATKKPVVNIITPSHVEERGCQLTITF<br>SVPNKDVFQELEKRGVVCDKRNPNGIRVAPVPLYNS<br>FHDVYKFTNLLTSILDSAETKN* |
| *Shewanella*<br>SEQ ID NO:<br>67 | Q8E973 | MLLNVKQDFCLAGPGYLLNHSVGRPLKSTEQALKQA<br>FFAPWQESGREPWGQWLGVIDNFTAALASLFNGQPQ<br>DFCPQVNLSSALTKIVMSLDRLTRDLTRNGGAVVLM<br>SEIDFPSMGFALKKALPASCELRFIPKSLDVTDPNVW<br>DAHICDDVDLVFVSHAYSNTGQQAPLAQIISLARERG<br>CLSLVDVAQSAGILPLDLAKLQPDFMIGSSVKWLCSG<br>PGAAYLWVNPAILPECQPQDVGWFSHENPFEFDIHDF<br>RYHPTALRFWGGTPSIAPYAIAAHSIEYFANIGSQVM<br>REHNLQLMEPVVQALDNELVSPQEVDKRSGTIILQFG<br>ERQPQILAALAAANISVDTRSLGIRVSPHIYNDEADIA<br>RLLGVIKANR* |

*designates the position of the stop codon

In one embodiment, one or more polypeptides and/or polynucleotides encoded and expressed by the genetically engineered bacteria have at least about 80% identity with one or more of SEQ ID NO: 65 through SEQ ID NO: 67. In one embodiment, one or more polypeptides and/or polynucleotides encoded and expressed by the genetically engineered bacteria have at least about 85% identity with one or more of SEQ ID NO: 65 through SEQ ID NO: 67. In one embodiment, one or more polypeptides and/or polynucleotides encoded and expressed by the genetically engineered bacteria have at least about 90% identity with one or more of SEQ ID NO: 65 through SEQ ID NO: 67. In one embodiment, one or more polypeptides and/or polynucleotides encoded and expressed by the genetically engineered bacteria have at least about 95% identity with one or more of SEQ ID NO: 65 through SEQ ID NO: 67. In one embodiment, one or more polypeptides and/or polynucleotides encoded and expressed by the genetically engineered bacteria have at least about 96%, 97%, 98%, or 99% identity with one or more of SEQ ID NO: 65 through SEQ ID NO: 67. Accordingly, in one embodiment, one or more polypeptides and/or polynucleotides expressed by the genetically engineered bacteria have at least about 80%, 81%, 82%, 83%, 84%, 85%, 86%, 87%, 88%, 89%, 90%, 91%, 92%, 93%, 94%, 95%, 96%, 97%, 98%, or 99% identity with one or more of SEQ ID NO: 65 through SEQ ID NO: 67. In another embodiment, one or more polynucleotides and/or polypeptides encoded and expressed by the genetically engineered bacteria comprise the sequence of one or more of SEQ ID NO: 65 through SEQ ID NO: 67. In another embodiment, one or more polynucleotides and/or polypeptides encoded and expressed by the genetically engineered bacteria consist of the sequence of one or more of SEQ ID NO: 65 through SEQ ID NO: 67.

TABLE 10

Selected codon-optimized kynureninase cassette sequences

| Kynureninase<br>protein sequences | Kynureninase protein sequences |
|---|---|
| kynU<br>(*Pseudomonas*)<br>SEQ ID NO: 68 | atgacgacccgaaatgattgcctagcgttggatgcacaggacagtctggctccgctgcgccaa<br>caatttgcgctgccggagggtgtgatatacctggatggcaattcgctgggcgcacgtccggtag<br>ctgcgctggctcgcgcgcaggctgtgatcgcagaagaatggggcaacgggttgatccgttcat<br>ggaactctgcgggctggcgtgatctgtctgaacgcctgggtaatcgcctggctaccctgattggt<br>gcgcgcgatggggaagtagttgttactgataccacctcgattaatctgtttaaagtgctgtcagcg<br>gcgctgcgcgtgcaagctacccgtagcccggagcgccgtgttatcgtgactgagacctcgaatt<br>tcccgaccgacctgtatattgcggaagggttggcggatatgctgcaacaaggttacactctgcgt<br>ttggtggattcaccggaagagctgccacaggctatagatcaggacaccgcggtggtgatgctg<br>acgcacgtaaattataaaaccggttatatgcacgacatgcaggctctgaccgcgttgagccacg<br>agtgtggggctctggcgatttgggatctggcgcactctgctggcgctgtgccggtggacctgca<br>ccaagcgggcgcggactatgcgattggctgcacgtacaaatacctgaatggcggcccgggttc<br>gcaagcgtttgtttgggtttcgccgcaactgtgcgacctggtaccgcagccgctgtctggttggtt<br>cggccatagtcgccaattcgcgatggagccgcgctacgaaccttctaacggcattgctcgctat<br>ctgtgcggcactcagcctattactagcttggctatggtggagtgcggcctggatgtgtttgcgca |

TABLE 10-continued

Selected codon-optimized kynureninase cassette sequences

| Kynureninase protein sequences | Kynureninase protein sequences |
|---|---|
| | gacggatatggcttcgctgcgccgtaaaagtctggcgctgactgatctgttcatcgagctggttg<br>aacaacgctgcgctgcacacgaactgaccctggttactccacgtgaacacgcgaaacgcggct<br>ctcacgtgtcttttgaacaccccgagggttacgctgttattcaagctctgattgatcgtggcgtgat<br>cggcgattaccgtgagccacgtattatgcgtttcggtttcactcctctgtatactacttttacggaag<br>tttgggatgcagtacaaatcctgggcgaaatcctggatcgtaagacttgggcgcaggctcagttt<br>caggtgcgccactctgttacttaaaaataaaacgaaaggctcagtcgaaagactgggcctttc<br>gttttatctgttg |
| Ptet-kynU(Pseudomonas) SEQ ID NO: 865 | atctaatctagacatcattaattcctaattttttgttgacactctatcattgatagagttattta<br>ccactccctatcagtgatagagaaaagtgaattatataaaagtgggaggtgcccgaatgacg<br>acccgaaatgattgcctagcgttggatgcacaggacagtctggctccgctgcgccaacaatttg<br>cgctgccggagggtgtgatatacctggatggcaattcgctgggcgcacgtccggtagctgcgc<br>tggctcgcgcgcaggctgtgatcgcagaagaatggggcaacggttgatccgttcatggaact<br>ctgcgggctggcgtgatctgtctgaacgcctgggtaatcgcctggctaccctgattggtgcgcg<br>cgatggggaagtagttgttactgataccacctcgattaatctgtttaaagtgctgtcagcggcgct<br>gcgcgtgcaagctacccgtagcccggagcgccgtgttatcgtgactgagacctcgaatttcccg<br>accgacctgtatattgcggaagggttggcggatatgctgcaacaaggttacactctgcgtttggt<br>ggattcaccggaagagctgccacaggctatagatcaggacaccgcggtggtgatgctgacgc<br>acgtaaattataaaaccggttatatgcacgacatgcaggctctgaccgcgttgagccacgagtgt<br>ggggctctggcgatttgggatctggcgcactctgctggcgctgtgccggtggacctgcaccaa<br>gcgggcgcggactatgcgattggctgcacgtacaaatacctgaatggcggcccgggttcgcaa<br>gcgtttgtttgggtttcgccgcaactgtgcgacctggtaccgcagccgctgtctggttggttcggc<br>catagtcgccaattcgcgatggagccgcgctacgaaccttctaacggcattgctcgctatctgtg<br>cggcactcagcctattactagcttggctatggtggagtgcggcctggatgtgtttgcgcagacgg<br>atatggcttcgctgcgccgtaaaagtctggcgctgactgatctgttcatcgagctggttgaacaac<br>gctgcgctgcacacgaactgaccctggttactccacgtgaacacgcgaaacgcggctctcacg<br>tgtcttttgaacaccccgagggttacgctgttattcaagctctgattgatcgtggcgtgatcggcga<br>ttaccgtgagccacgtattatgcgtttcggtttcactcctctgtatactacttttacggaagtttggga<br>tgcagtacaaatcctgggcgaaatcctggatcgtaagacttgggcgcaggctcagtttcaggtg<br>cgccactctgttacttaaaaataaaacgaaaggctcagtcgaaagactgggcctttcgttttat<br>ctgttg |
| kynU(Human) SEQ ID NO: 69 | atggagccttcatctttagaactgccagcggacacggtgcagcgcatcgcggcggaactgaag<br>tgccatccgactgatgagcgtgtggcgctgcatctggacgaagaagataaactgcgccactttc<br>gtgaatgttttatattcctaaaattcaagacttgccgccggtagatttgagtctcgttaacaaagat<br>gaaaacgcgatctactttctgggcaactctctgggtctgcaaccaaaaatggttaaaacgtacct<br>ggaggaagaactggataaatgggcaaaaatcgcggcttatggtcacgaagtgggcaagcgtc<br>cttggattactggcgacgagtctattgtgggtttgatgaaagatattgtgggcgcgaatgaaaag<br>gaaattgcactgatgaatgctctgaccgttaatctgcacctgctgatgctgtcttttttaaaccgac<br>cccgaaacgctacaaaatactgctggaagcgaaagcgtttccgtcggatcactatgctatagaa<br>agtcaactgcagttgcatggtctgaatatcgaggaatctatgcgcatgattaaaccgcgtgaggg<br>tgaagaaacgctgcgtattgaagacattctggaagttattgaaaaagaaggtgattctatcgcagt<br>tatactgttttctggcgtgcacttttatacaggtcagcacttcaatatcccggcaatcactaaagcg<br>gggcaggcaaaaggctgctatgttggttttgacctggcgcatgcagtggggaatgttgaactgta<br>tctgcacgattggggcgttgatttcgcgtgttggtgtagctacaaatatctgaacgctggcgcgg<br>gtggcattgctggcgcttttattcacgaaaaacacgcgcacaccattaaaccggctctggttggct<br>ggttcggtcatgagctgagtactcgctttaaaatggataacaaactgcaattgattccgggtgttg<br>cggcttccgtatcagcaatccgccgattctgctggtttgcagcctgcacgctagtctggaaatcttt<br>aagcaggcgactatgaaagcgctgcgcaaaaaatctgtgctgctgaccggctatctggagtatc<br>tgatcaaacacaattatggcaaagataaagctgcaactaaaaaaccggtagtgaacattatcacc<br>ccctcacacgtggaggagcgcggttgtcagctgactattactttcagtgtacctaataaagatgtg<br>ttccaggaactggaaaaacgcggcgttgtttgtgataaacgtaacccgaatggtattcgcgtggc<br>tcctgtgccgctgtacaattcattccacgatgtttataaattcaccaacctgctgacttctattctcga<br>cagtgctgagactaaaaattaaaaataaaacgaaaggctcagtcgaaagactgggcctttcg<br>ttttatctgttg |
| Ptet-kynU(Human) SEQ ID NO: 866 | atctaatctagacatcattaattcctaattttttgttgacactctatcattgatagagttattta<br>ccactccctatcagtgatagagaaaaagtgaatatcaagacacgaggaggtaagatt**atgga<br>gccttcatctttagaactgccagcggacacggtgcagcgcatcgcggcggaactgaagtgcca<br>tccgactgatgagcgtgtggcgctgcatctggacgaagaagataaactgcgccactttcgtgaa<br>tgttttatattcctaaaattcaagacttgccgccggtagatttgagtctcgttaacaaagatgaaaa<br>cgcgatctactttctgggcaactctctgggtctgcaaccaaaaatggttaaaacgtacctggagg<br>aagaactggataaatgggcaaaaatcgcggcttatggtcacgaagtgggcaagcgtccttggat<br>tactggcgacgagtctattgtgggtttgatgaaagatattgtgggcgcgaatgaaaagggaattg<br>cactgatgaatgctctgaccgttaatctgcacctgctgatgctgtcttttttaaaccgaccccgaaa<br>cgctacaaaatactgctggaagcgaaagcgtttccgtcggatcactatgctatagaaagtcaact<br>gcagttgcatggtctgaatatcgaggaatctatgcgcatgattaaaccgcgtgagggtgaagaa<br>acgctgcgtattgaagacattctggaagttattgaaaaagaaggtgattctatcgcagttatactgt<br>tttctggcgtgcacttttatacaggtcagcacttcaatatcccggcaatcactaaagcggggcagg<br>caaaaggctgctatgttggttttgacctggcgcatgcagtggggaatgttgaactgtatctgcacg<br>attggggcgttgatttcgcgtgttggtgtagctacaaatatctgaacgctggcgcgggtggcattg<br>ctggcgcttttattcacgaaaaacacgcgcacaccattaaaccggctctggttggcggttcggtc<br>atgagctgagtactcgctttaaaatggataacaaactgcaattgattccgggtgtttgcggcttccg<br>tatcagcaatccgccgattctgctggtttgcagcctgcacgctagtctggaaatctttaagcaggc<br>gactatgaaagcgctgcgcaaaaaatctgtgctgctgaccggctatctggagtatctgatcaaac |

TABLE 10-continued

Selected codon-optimized kynureninase cassette sequences

| Kynureninase protein sequences | Kynureninase protein sequences |
|---|---|
| | acaattatggcaaagataaagctgcaactaaaaaaccggtagtgaacattatcaccccctcacac gtggaggagcgcggttgtcagctgactattactttcagtgtacctaataaagatgtgttccaggaa ctggaaaaacgcggcgttgtttgtgataaacgtaacccgaatggtattcgcgtggctcctgtgcc gctgtacaattcattccacgatgtttataaattcaccaacctgctgacttctattctcgacagtgctga gactaaaaattaaaaataaaacgaaaggctcagtcgaaagactgggcctttcgttttatctgttg |
| kynU(Shewanella) SEQ ID NO: 70 | atgctgctgaatgtaaaacaggacttttgcctggcaggcccgggctacctgctgaatcactcggt tggccgtccgctgaaatcaactgagcaagcgctgaaacaagcatttttttgctccgtggcaagag agcggtcgtgaaccgtggggccagtggctgggtgttattgataatttcactgctgcgctggcatc tctgtttaatggtcaaccgcaggattttttgtccgcaggttaacctgagcagcgcgctgactaaaatt gtgatgtcactggatcgtctgactcgcgatctgacccgcaatggcggtgctgttgtgctgatgtct gaaatcgatttcccatctatgggcttcgcgttgaaaaaagcgctgccagcgagctgcgaactgc gttttatcccgaaaagtctggacgtgactgatccgaacgtatgggatgcacacatctgtgatgatg tagacctggtttttgtgtctcacgcctatagtaatacgggccaacaggctccgctggcgcaaatca tctctctggcgcgtgaacgtggctgcctgtcactggtggatgtagcgcaatcagcggggattttg ccgctggatctggcgaaactgcaaccggacttcatgatcggcagttcggttaaatggctgtgctc gggccctggtgcggcatatctgtgggttaatccggcgattctgccggaatgtcagccgcaggat gtgggctggttttcacatgagaatccctttgaattcgacatccacgatttccgctaccacccgactg cactgcgcttttgggtggtacgccgtcgatcgcgccttatgcgatcgcggcgcactcgatcga atattttgccaatatcggctcgcaagtgatgcgtgaacacaacctgcaactgatggaaccggtgg ttcaggcgctggacaatgaactggtgagcccgcaggaagtggataaacgctcaggcactattat tctgcaattcggtgaacgtcaaccgcaaattctggcggctctggctgcggcgaacatttcggtgg acactcgttctttggggattcgtgttagtccgcacatttataatgatgaggcggacattgcgcgcct gctgggtgtgatcaaagcaaatcgctaaaaataaaacgaaaggctcagtcgaaagactgggcc tttcgttttatctgttg |
| ptet-kynU(Shewanella) SEQ ID NO: 867 | atctaatctagacatcattaattcctaattttttgttgacactctatcattgatagagttatttta ccactccctatcagtgatagagaaaagtgaa<u>tggttcaccaccacaaggagggatt</u>atgctg ctgaatgtaaaacaggacttttgcctggcaggcccgggctacctgctgaatcactcggttgcc gtccgctgaaatcaactgagcaagcgctgaaacaagcatttttttgctccgtggcaagagagcgg tcgtgaaccgtggggccagtggctgggtgttattgataatttcactgctgcgctggcatctctgttt aatggtcaaccgcaggattttttgtccgcaggttaacctgagcagcgcgctgactaaaattgtgat gtcactggatcgtctgactcgcgatctgacccgcaatggcggtgctgttgtgctgatgtctgaaat cgatttcccatctatgggcttcgcgttgaaaaaagcgctgccagcgagctgcgaactgcgttttat cccgaaaagtctggacgtgactgatccgaacgtatgggatgcacacatctgtgatgatgagac ctggttttgtgtctcacgcctatagtaatacgggccaacaggctccgctggcgcaaatcatctct ctggcgcgtgaacgtggctgcctgtcactggtggatgtagcgcaatcagcggggattttgccgc tggatctggcgaaactgcaaccggacttcatgatcggcagttcggttaaatggctgtgctcgggc cctggtgcggcatatctgtgggttaatccggcgattctgccggaatgtcagccgcaggatgtgg gctggttttcacatgagaatccctttgaattcgacatccacgatttccgctaccacccgactgcact gcgcttttgggtggtacgccgtcgatcgcgccttatgcgatcgcggcgcactcgatcgaatatt ttgccaatatcggctcgcaagtgatgcgtgaacacaacctgcaactgatggaaccggtggttca ggcgctggacaatgaactggtgagcccgcaggaagtggataaacgctcaggcactattattctg caattcggtgaacgtcaaccgcaaattctggcggctctggctgcggcaacatttcggtggaca ctcgttctttggggattcgtgttagtccgcacatttataatgatgaggcggacattgcgcgcctgct gggtgtgatcaaagcaaatcgctaaaaataaaacgaaaggctcagtcgaaagactgggcctttc gttttatctgttg |

The ptet-promoter is in bold, designed Ribosome binding site is underlined, codon-optimized protein coding sequence is in plain text, and the terminator is in italics.

In some embodiments, the genetically engineered bacteria and/or other microorganisms comprise one or more nucleic acid sequence of Table 10 or a functional fragment thereof. In some embodiments, the genetically engineered bacteria and/or other microorganisms comprise a nucleic acid sequence that, but for the redundancy of the genetic code, encodes the same polypeptide as one or more nucleic acid sequence of Table 10 or a functional fragment thereof. In some embodiments, genetically engineered bacteria and/or other microorganisms comprise a nucleic acid sequence that is at least about 80%, at least about 85%, at least about 90%, at least about 95%, or at least about 99% homologous to the DNA sequence of one or more nucleic acid sequence of Table 10 or a functional fragment thereof, or a nucleic acid sequence that, but for the redundancy of the genetic code, encodes the same polypeptide as one or more nucleic acid sequence of Table 10 or a functional fragment thereof.

In one embodiment, one or more polynucleotides encoded and expressed by the genetically engineered bacteria have at least about 80% identity with one or more of SEQ ID NO: 68 through SEQ ID NO: 70 and SEQ ID NO: 865 through SEQ ID NO: 868. In one embodiment, one or more polynucleotides encoded and expressed by the genetically engineered bacteria have at least about 85% identity with one or more of SEQ ID NO: 68 through SEQ ID NO: 70 and SEQ ID NO: 865 through SEQ ID NO: 868. In one embodiment, one or more polynucleotides encoded and expressed by the genetically engineered bacteria have at least about 90% identity with one or more of SEQ ID NO: 68 through SEQ ID NO: 70 and SEQ ID NO: 865 through SEQ ID NO: 868. In one embodiment, one or more polynucleotides encoded and expressed by the genetically engineered bacteria have at least about 95% identity with one or more of SEQ ID NO: 68 through SEQ ID NO: 70 and SEQ ID NO: 865 through SEQ ID NO: 868. In one embodiment, one or more polynucleotides encoded and expressed by the genetically engineered bacteria have at least about 96%, 97%, 98%, or 99% identity with one or more of SEQ ID NO: 68 through SEQ ID NO: 70 and SEQ ID NO: 865 through SEQ ID NO: 868. Accordingly, in one embodiment, one or more polynucleotides expressed by the genetically engineered bacteria have at least about 80%, 81%, 82%, 83%, 84%, 85%, 86%, 87%, 88%, 89%, 90%, 91%, 92%, 93%, 94%, 95%, 96%, 97%, 98%, or 99% identity with one or more of SEQ ID NO: 68 through SEQ ID NO: 70 and SEQ ID NO: 865 through SEQ ID NO: 868. In another embodiment, one or more polynucleotides encoded and expressed by the genetically engineered bacteria comprise the sequence of one or more of SEQ ID NO: 68 through SEQ ID NO: 70 and SEQ ID NO: 865 through SEQ ID NO: 868. In another embodiment, one or more polynucleotides encoded and expressed by the genetically engineered bacteria consists of the sequence of one or more of SEQ ID NO: 68 through SEQ ID NO: 70 and SEQ ID NO: 865 through SEQ ID NO: 868.

In some embodiments, the kynureninase is secreted into the extracellular environment, e.g., tumor microenvironment, using a secretion system described herein.

The genetically engineered bacteria and/or other microorganisms may comprise any suitable gene for producing kynureninase. In some embodiments, the gene for producing kynureninase is modified and/or mutated, e.g., to enhance stability, increase kynureninase production. In some embodiments, the engineered bacteria and/or other microorganisms also have enhanced uptake or import of kynurenine, e.g., comprise a transporter or other mechanism for increasing the uptake of kynurenine into the bacteria and/or other microorganisms' cell. In some embodiments, the genetically engineered bacteria and/or other microorganisms are capable of producing kynureninase under inducing conditions, e.g., under a condition(s) associated with immune suppression and/or tumor microenvironment. In some embodiments, the genetically engineered bacteria and/or other microorganisms are capable of producing kynureninase in low-oxygen conditions, in the presence of certain molecules or metabolites, in the presence of molecules or metabolites associated with cancer, or certain tissues, immune suppression, or inflammation, or in the presence of some other metabolite that may or may not be present in the gut, such as arabinose.

In some embodiments, the genetically engineered bacteria and/or other microorganisms are capable of expressing any one or more of the described circuits in low-oxygen conditions, and/or in the presence of cancer and/or the tumor microenvironment and/or the tumor microenvironment or tissue specific molecules or metabolites, and/or in the presence of molecules or metabolites associated with inflammation or immune suppression, and/or in the presence of metabolites that may be present in the gut, and/or in the presence of metabolites that may or may not be present in vivo, and may be present in vitro during strain culture, expansion, production and/or manufacture, such as arabinose and others described herein. In some embodiments, the gene sequences(s) are controlled by a promoter inducible by such conditions and/or inducers. In some embodiments, the gene sequences(s) are controlled by a constitutive promoter, as described herein. In some embodiments, the gene sequences(s) are controlled by a constitutive promoter, and are expressed in in vivo conditions and/or in vitro conditions, e.g., during bacteria and/or other microorganisms' expansion, production and/or manufacture, as described herein.

In some embodiments, any one or more of the described circuits are present on one or more plasmids (e.g., high copy or low copy) or are integrated into one or more sites in the bacteria and/or other microorganisms' chromosome. Also, in some embodiments, the genetically engineered bacteria and/or other microorganisms are further capable of expressing any one or more of the described circuits and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, (6) one or more surface display circuits, such as any of the surface display circuits described herein and otherwise known in the art (7) one or more circuits for the production or degradation of one or more metabolites (e.g., kynurenine, tryptophan, adenosine, arginine) described herein and (8) combinations of one or more of such additional circuits.

Increasing Tryptophan and Decreasing Kynurenine

In some embodiments, the genetically engineered bacteria and/or other microorganisms comprise a mechanism for metabolizing or degrading kynurenine, which, in some embodiments, also results in the increased production of tryptophan. In some embodiments, the genetically engineered bacteria modulate the TRP:KYN ratio or the KYN:TRP ratio in the extracellular environment. In some embodiments, the genetically engineered bacteria increase the TRP:KYN ratio or the KYN:TRP ratio. In some embodiments, the genetically engineered bacteria reduce the TRP:KYN ratio or the KYN:TRP ratio. In some embodiments, the genetically engineered bacteria comprise sequence encoding the enzyme kynureninase. Kynureninase is produced to metabolize Kynurenine to Anthranilic acid in the cell. Schwarcz et al., Nature Reviews Neuroscience, 13, 465-477; 2012; Chen & Guillemin, 2009; 2; 1-19; Intl. J. Tryptophan Res. Exemplary kynureninase sequences are provided herein below in Table 9. In some embodiments, the engineered microbe has a mechanism for importing (transporting) kynurenine from the local environment into the cell. In some embodiments, the genetically engineered bacteria comprise one or more copies of aroP, tnaB or mtr gene. In some embodiments, the genetically engineered bacteria comprise gene sequence(s) encoding a kynureninase secreter.

In some embodiments, the genetically engineered bacteria comprise gene sequence(s) encoding enzymes of the tryptophan biosynthetic pathway and sequence encoding kynureninase. In some embodiments, the genetically engineered bacteria comprise a tryptophan operon, for example that of E. coli. or B. subtilis, and sequence encoding kynureninase. In some embodiments, the genetically engineered bacteria comprise sequence(s) encoding trypE, trypG-D, trypC-F, trypB, and trpA genes, for example, from E. coli and sequence encoding kyureninase. In some embodiments, the genetically engineered bacteria comprise sequence(s) encoding trypE, trypD, trypC, trypF, trypB, and trpA genes, for example from B. subtilis and sequence encoding kyureninase. In any of these embodiments, the tryptophan repressor (trpR) optionally may be deleted, mutated, or modified so as to diminish or obliterate its repressor function. Also, in any of these embodiments, the genetically engineered bacteria optionally comprise gene sequence(s) to produce the tryptophan precursor, Chorismate, for example, sequence(s) encoding aroG, aroF, aroH, aroB, aroD, aroE, aroK, and AroC. Thus, in some embodiments, the genetically engineered bacteria comprise sequence(s) encoding trypE, trypG-D, trypC-F, trypB, and trpA genes from *E. coli*, sequence(s) encoding aroG, aroF, aroH, aroB, aroD, aroE, aroK, and AroC genes, and sequence encoding kyureninase. In some embodiments, the genetically engineered bacteria comprise sequence(s) encoding trypE, trypD, trypC, trypF, trypB, and trpA genes from *B. subtilis*, sequence(s) encoding aroG, aroF, aroH, aroB, aroD, aroE, aroK, and AroC genes, and sequence encoding kyureninase.

Optionally, the trpE gene may be deleted as it is not needed for the generation of tryptophan from kynurenine. Accordingly, in one embodiment, the genetically engineered bacteria may comprise one or more gene(s) or gene cassette(s) encoding trpD, trpC, trpA, and trpD and kynureninase (see, e.g. FIG. 13). This deletion may prevent tryptophan production through the endogenous chorismate pathway, and may increase the production of tryptophan from kynurenine through kynureninase.

In alternate embodiments, the trpE gene is not deleted, in order to maximize tryptophan production by using both kynurenine and chorismate as a substrate. In one embodiment of the invention, the genetically engineered bacteria comprising this circuit may be useful for reducing immune escape in cancer.

In some embodiments, the genetically engineered bacteria comprise sequence(s) encoding either a wild type or a feedback resistant SerA gene (Table 86).

In any of these embodiments, AroG and TrpE are optionally replaced with feedback resistant versions to improve tryptophan production (Table 86).

In any of these embodiments, the tryptophan repressor (trpR) optionally may be deleted, mutated, or modified so as to diminish or obliterate its repressor function.

In any of these embodiments the tnaA gene (encoding a tryptophanase converting Trp into indole) optionally may be deleted to prevent tryptophan catabolism along this pathway and to further increase levels of tryptophan produced (Table 86).

In any of these embodiments, the genetically engineered bacterium may further comprise gene sequence for exporting or secreting tryptophan from the cell. Thus, in some embodiments, the engineered bacteria further comprise gene sequence(s) encoding YddG. In some embodiments, the engineered bacteria can over-express YddG, an aromatic amino acid exporter. In some embodiments, the engineered bacteria optionally comprise one or more copies of yddG gene. In any of these embodiments, the genetically engineered bacterium may further comprise gene sequence for importing or transporting kynurenine into the cell. Thus, in some embodiments, the genetically engineered bacteria comprise gene sequence(s) encoding a kynureninase secreter. In some embodiments, the genetically engineered bacteria comprise one or more copies of aroP, tnaB or mtr gene.

In some embodiments, the kynureninase is secreted into the extracellular environment, e.g., tumor microenvironment, using a secretion system described herein, e.g., and are useful for degradation of kynurenine outside of the cell.

In some embodiments, one or more tryptophan production enzymes are secreted into the extracellular environment, e.g., tumor microenvironment, using a secretion system described herein.

The genetically engineered bacteria may comprise any suitable gene for producing kynureninase and tryptophan production. In some embodiments, the genes for producing kynureninase and/or tryptophan production enzymes are modified and/or mutated, e.g., to enhance stability, increase kynurenine consumption and/or tryptophan production. In some embodiments, the engineered bacteria also have enhanced uptake or import of tryptophan or kynurenine, e.g., comprise a transporter or other mechanism for increasing the uptake of tryptophan or kynurenine into the bacterial cell, as discussed in detail above. In some embodiments, the genetically engineered bacteria are capable of producing kynureninase and tryptophan production enzymes under inducing conditions, e.g., under a condition(s) associated with immune suppression or cancer tissue. In some embodiments, the genetically engineered bacteria are capable of producing kynureninase and tryptophan production enzymes in low-oxygen conditions. In some embodiments, the genetically engineered bacteria are capable of producing kynureninase and tryptophan production enzymes in the presence of certain molecules or metabolites, in the presence of molecules or metabolites associated with cancer, certain tissues, immune suppression, or in the presence of some other metabolite that may or may not be present in the gut, such as arabinose.

In some embodiments, the genetically engineered microorganisms are capable of expressing any one or more of the described circuits in low-oxygen conditions, and/or in the presence of cancer and/or the tumor microenvironment, or tissue specific molecules or metabolites, and/or in the presence of molecules or metabolites associated with inflammation or immune suppression, and/or in the presence of metabolites that may be present in the gut, and/or in the presence of metabolites that may or may not be present in vivo, and may be present in vitro during strain culture, expansion, production and/or manufacture, such as arabinose and others described herein. In some embodiments, the gene sequences(s) are controlled by a promoter inducible by such conditions and/or inducers. In some embodiments, the gene sequences(s) are controlled by a constitutive promoter, as described herein. In some embodiments, the gene sequences(s) are controlled by a constitutive promoter, and are expressed in in vivo conditions and/or in vitro conditions, e.g., during expansion, production and/or manufacture, as described herein.

In some embodiments, any one or more of the described circuits are present on one or more plasmids (e.g., high copy or low copy) or are integrated into one or more sites in the microorganisms' chromosome. Also, in some embodiments, the genetically engineered microorganisms are further capable of expressing any one or more of the described circuits and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, (6) one or more surface display circuits, such as any of the surface display circuits described herein and otherwise known in the art and (7) one or more circuits for the production or degradation of one or more metabolites (e.g., kynurenine, tryptophan, adenosine, arginine) described herein (8) combinations of one or more of such additional circuits.

ALE

In the tumor microenvironment the amino acid tryptophan (TRP) and its degradation product kynurenine (KYN) play pivotal roles as immunomodulatory signals. Tumors often degrade TRP (which has proinflammatory properties) into KYN, which possesses anti-inflammatory characteristics, thereby promoting evasion from immune surveillance.

E. coli Nissle can be engineered to efficiently import KYN and convert it to TRP. While Nissle does not typically utilize KYN, by introducing the Kynureninase (KYNase) from Pseudomonas fluorescens (kynU) on a medium-copy plasmid under the control of the tetracycline promoter (Ptet) a new strain with this plasmid (Ptet-KYNase) is able to convert L-kynurenine into anthranilate.

E. coli naturally utilizes anthranilate in its TRP biosynthetic pathway. Briefly, the TrpE (in complex with TrpD) enzyme converts chorismate into anthranilate. TrpD, TrpC, TrpA and TrpB then catalyze a five-step reaction ending with the condensation of an indole with serine to form tryptophan. By replacing the TrpE enzyme via lambda-RED recombineering, the subsequent strain of Nissle ($\Delta$trpE::Cm) is an auxotroph unable to grow in minimal media without supplementation of TRP or anthranilate. By expressing kynureninase in $\Delta$trpE::Cm (KYNase-trpE), this auxotrophy can be alternatively rescued by providing KYN.

Leveraging the growth-limiting nature of KYN in KYNase-trpE, adaptive laboratory evolution was employed to evolve a strain capable of increasingly efficient utilization of KYN. First a lower limit of KYN concentration was established and mutants were evolved by passaging in lowering concentrations of KYN. While this can select for mutants capable of increasing KYN import, the bacterial cells still prefer to utilize free, exogenous TRP. In the tumor environment, dual-therapeutic functions can be provided by depletion of KYN and increasing local concentrations of TRP. Therefore, to evolve a strain which prefers KYN over TRP, a toxic analogue of TRP—5-fluoro-L-tryptophan (Tox-TRP)—can be incorporated into the ALE experiment. The resulting best performing strain is then whole genome sequenced in order to deconvolute the contributing mutations. Lambda-RED can be performed in order to reintroduce TrpE, to inactivate Trp regulation (trpR, tyrR, transcriptional attenuators) to up-regulate TrpABCDE expression and increase chorismate production. The resulting strain is now insensitive to external TRP, efficiently converts KYN into TRP, and also now overproduces TRP.

Purinergic System—ATP/Adenosine Metabolism

An important barrier to successful cancer immunotherapy is that tumors employ a number of mechanisms to facilitate immune escape, including the production of anti-inflammatory cytokines, the recruitment of regulatory immune subsets, and the production of immunosuppressive metabolites. One such immunosuppressive pathway is the production of extracellular adenosine, a potent immunosuppressive molecule, by CD73. The purinergic system regulates and refines immune cell functions, such as cell-to-cell interactions, cytokine and chemokine secretion, surface antigen shedding, intracellular pathogen removal, and generating reactive oxygen species. Extracellular ATP, released by damaged or dying cells and bacteria, promotes the recruitment of immune phagocytes and activates P2X7R, a coactivator of the NLRP3 inflammasome, which then triggers the production of proinflammatory cytokines, such as IL-1$\beta$ and IL-18. The catabolism of extracellular ATP into ADP, AMP and adenosine is controlled by glycosylphosphatidylinositol (GPI-) anchored ectonucleotidases and membrane-bound kinases. CD39 (ecto-nucleoside triphosphate diphosphohydrolase 1, E-NTPDase1) hydrolyzes ATP into AMP, which is then dephosphorylated into adenosine by CD73 (ecto-5'-nucleotidase, Ecto5'NTase). Thus, CD39 and CD73 act in concert to convert proinflammatory ATP into immunosuppressive adenosine. Notably, the activity of CD39 is reversible by the actions of NDP kinase and adenylate kinase, whereas the activity of CD73 is virtually irreversible. Thus, CD73 represents a crucial checkpoint in the conversion of an ATP-driven proinflammatory environment to an anti-inflammatory milieu induced by adenosine. Stated another way, CD73 negatively regulates the proinflammatory effects of extracellular adenosine triphosphate (ATP).

In the tumor setting, CD39 and CD73 generate increased adenosine levels characteristic of the tumor microenvironment. High expression and activity of CD39 and CD73 has been observed in several blood or solid tumors. In addition, CD39- and CD73-expressing cancer exosomes can also raise adenosine levels within the tumor microenvironment. The CD39/CD73 complex participates in the process of tumor immunoescape, by inhibiting the activation, clonal expansion, and homing of tumor-specific T cells (in particular, T helper and cytotoxic T cells), impairing tumor cell killing by cytolytic effector T lymphocytes, and inducing the suppressive capabilities of Treg and Th17 cells, and enhancing the conversion of type 1 macrophages into tumor-promoting type 2 macrophages (reviewed in Antonioli et al., Trends Mol Med. 2013 June; 19(6): 355-367. CD39 and CD73 in immunity and inflammation). Myeloid-derived suppressor cells (MDSCs), also appear to promote tumor growth by a CD39-mediated mechanism.

Beside its immunoregulatory roles, the ectonucleotidase pathway contributes directly to the modulation of cancer cell growth, differentiation, invasion, migration, metastasis, and tumor angiogenesis. Agents targeting these enzymes show anti-tumor efficacy and a favorable tolerability profile in several murine models of malignancy (Anonioli et al., 2013). In some embodiments, the engineered microorganisms of the present disclosure, e.g., engineered bacteria or engineered oncolytic virus, produce one or more anti-cancer molecules that inhibit the activity of CD39 and/or inhibit the activity of CD73. In certain embodiments, the genetically engineered bacteria or genetically engineered oncolytic viruses produce an anti-cancer molecule that inhibits CD39 and/or an anti-cancer molecule that inhibits CD73, for example, the genetically engineered microorganism may encode an antibody directed against CD39 and/or an antibody directed against CD73, e.g. a single-chain antibody against CD39 and/or a single chain antibody against CD73. In some embodiments, the genetically engineered bacterium or genetically engineered oncolytic virus is a tumor-targeting bacterium or tumor-targeting oncolytic virus that expresses an anti-CD39 antibody and/or an anti-CD73 antibody, e.g., a single chain antibody. In some embodiments, the genetically engineered bacterium or genetically engineered oncolytic virus expresses an anti-CD39 antibody and/or an anti-CD73 antibody, e.g., single chain antibody, under the control of a promoter that is activated by low-oxygen conditions. In some embodiments, the genetically engineered bacterium or genetically engineered oncolytic virus is a tumor-targeting bacteria or tumor-targeting oncolytic virus that expresses an anti-CD39 and/or anti-CD73 antibody, e.g., single chain antibody, under the control of a promoter that is activated by low-oxygen conditions. In some embodiments, the genetically engineered bacterium or genetically engineered oncolytic virus express an anti-CD39 antibody and/or an anti-CD73 antibody, e.g., single chain antibody, under the control of a promoter that is activated by hypoxic conditions, or by inflammatory conditions, such as any of the promoters activated by said conditions and described herein. In some embodiments, the genetically engineered bacteria or genetically engineered OV expresses an anti-CD39 antibody and/or an anti-CD73 antibody, e.g., single chain antibody, under the control of a cancer-specific promoter, a tissue-specific promoter, or a constitutive promoter, such as any of the promoters described herein.

In some embodiments, the genetically engineered bacteria or genetically engineered oncolytic viruses comprise a means for removing excess adenosine from the tumor microenvironment. Many bacteria scavenge low concentrations of nucleosides from the environment for synthesis of nucleotides and deoxynucleotides by salvage pathways of synthesis. Additionally, in *Escherichia coli*, nucleosides can be used as the sole source of nitrogen and carbon for growth (Neuhard J, Nygaard P. Biosynthesis and conversion of nucleotides, purines and pyrimidines. In: Neidhardt F C, Ingraham J L, Low K B, Magasanik B, Schaechter M, Umbarger H E, editors. *Escherichia coli* and *Salmonella typhimurium*: Cellular and molecular biology. Washington D.C.: ASM Press; 1987. pp. 445-473). Two evolutionarily unrelated cation-linked transporter families, the Concentrative Nucleoside Transporter (CNT) family and the Nucleoside:H+ Symporter (NHS) family, are responsible for nucleoside uptake (see e.g., Cabrita et al., Biochem. Cell Biol. Vol. 80, 2002. Molecular biology and regulation of nucleoside and nucleobase transporter proteins in eukaryotes and prokaryotes), the contents of which is herein incorporated by reference in its entirety). NupC and NupG, are the transporter family members in *E. coli*. Mutants defective in both the nupC and nupG genes cannot grow with nucleosides as a single carbon source. Both of these transporters are proton-linked but they differ in their selectivity. NupG is capable of transporting a wide range of nucleosides and deoxynucleosides; in contrast, NupC does not transport guanosine or deoxyguanosine. Homologs of NupG from *E. coli* are found in a wide range of eubacteria, including human gut pathogens such as *Salmonella typhimurium*, organisms associated with periodontal disease such as *Porphyromonas gingivalis* and *Prevotella intermedia*, and plant pathogens in the genus *Erwinia* (As described in Vaziri et al., Mol Membr Biol. 2013 March; 30 (1-2): 114-128. Use of molecular modelling to probe the mechanism of the nucleoside transporter NupG, the contents of which is herein incorporated by reference in its entirety). Putative bacterial transporters from the CNT superfamily and transporters from the NupG/XapB family include those listed in the Tables 11 and 12 below. In addition, codB (GenBank P25525, *Escherichia coli*) was identified based on homology to a yeast transporter family termed the uracil/allantoin transporter family (Cabrita et al., supra).

TABLE 11

Putative CNT family transporters

| Name | GenBank Acc. No. | Organism |
| --- | --- | --- |
| BH1446 | BAB05165 | Bacillus halodurans |
| BsNupC | CAA57663 | B. subtilis |
| BsyutK | CAB15208 | B. subtilis |
| BsyxjA | CAB15938 | B. subtilis |
| CcCNT (CC2089) | AAK24060 | Caulobacter crescentus |
| (yeiJ) | AAC75222 | E. coli |
| (yeiM) | AAC75225 | E. coli |
| (HI0519) | AAC22177 | Haemophilus influenzae |
| (HP1180) | AAD08224 | Helicobacter pylori |
| (SA0600, SAV0645) | BAB41833, BAB56807 | Staphylococcus aureus |

TABLE 11-continued

Putative CNT family transporters

| Name | GenBank Acc. No. | Organism |
| --- | --- | --- |
| SpNupC | AAK34582 | Streptococcus pyogenes |
| (VC2352) | AAF95495 | Vibrio cholerae |
| (VC1953) | AAF95101 | V. cholera |
| (VCA0179) | AAF96092 | V. cholera |

TABLE 12

Bacterial transporters from the NupG/XapB family

| Protein (gene name) | GenBank accession No. | Organism |
| --- | --- | --- |
| 1. yegT | P76417 | Escherichia coli |
| 2. NupG | P09452 | E. coli |
| 3. XapB | P45562 | E. coli |
| 4. (CC1628) | AAK23606 | Caulobacter crescentus |

In some embodiments, the genetically engineered bacteria or genetically engineered oncolytic virus comprise a means for importing adenosine into the engineered bacteria or engineered virus from the tumor microenvironment. In some embodiments, the genetically engineered bacteria or genetically engineered oncolytic virus comprise sequence for encoding a nucleoside transporter. In some embodiments, the genetically engineered bacteria or genetically engineered oncolytic virus comprise sequence for encoding an adenosine transporter. In certain embodiments, genetically engineered bacteria or genetically engineered oncolytic virus comprise sequence for encoding *E. coli* Nucleoside Permease nupG or nupC. In any of these embodiments, the genetically engineered bacterium or genetically engineered oncolytic virus is a tumor-targeting bacterium or tumor-targeting oncolytic virus. In some embodiments, the genetically engineered bacterium or genetically engineered oncolytic virus comprises sequence for encoding a nucleoside transporter or an adenosine transporter, e.g., nupG or nupC transporter sequence, under the control of a promoter that is activated by low-oxygen conditions. In some embodiments, the genetically engineered bacterium or genetically engineered oncolytic virus comprises sequence for encoding a nucleoside transporter or an adenosine transporter, e.g., nupG or nupC transporter sequence, under the control of a promoter that is activated by hypoxic conditions, or by inflammatory conditions, such as any of the promoters activated by said conditions and described herein. In some embodiments, the genetically engineered bacteria or genetically engineered OV comprises sequence for encoding a nucleoside transporter or an adenosine transporter, e.g., nupG or nupC transporter sequence, under the control of a cancer-specific promoter, a tissue-specific promoter, or a constitutive promoter, such as any of the promoters described herein.

Figure 1C:
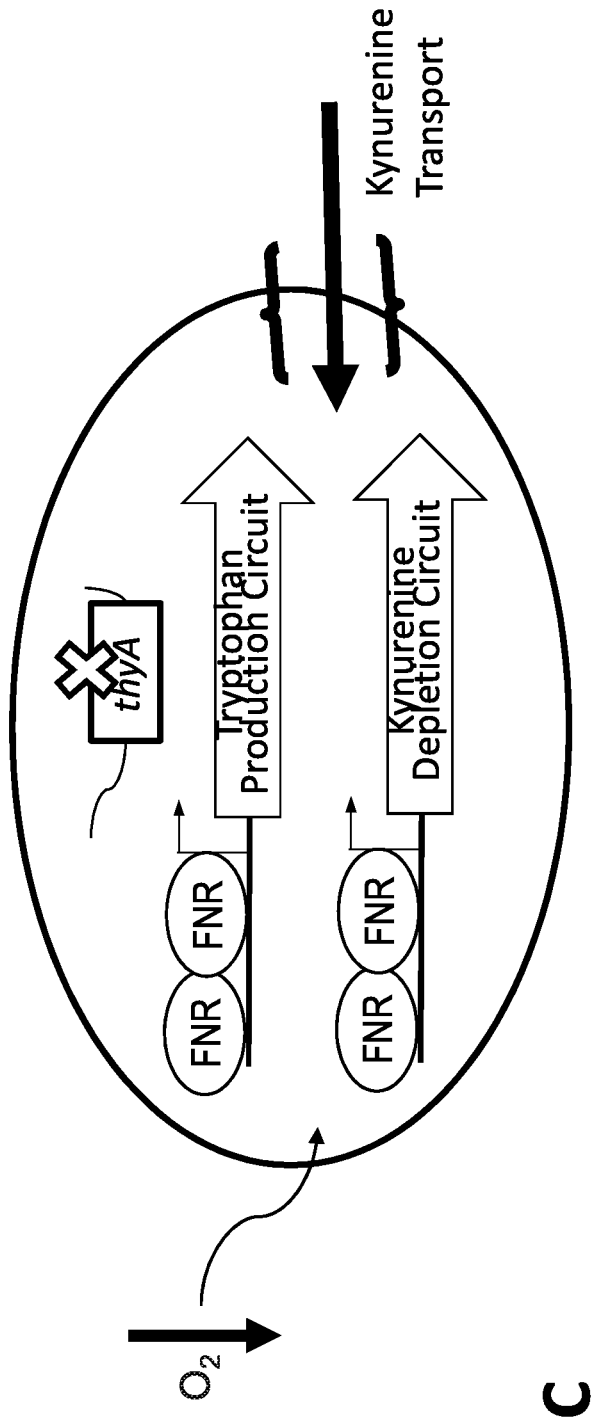
Figure 1D:
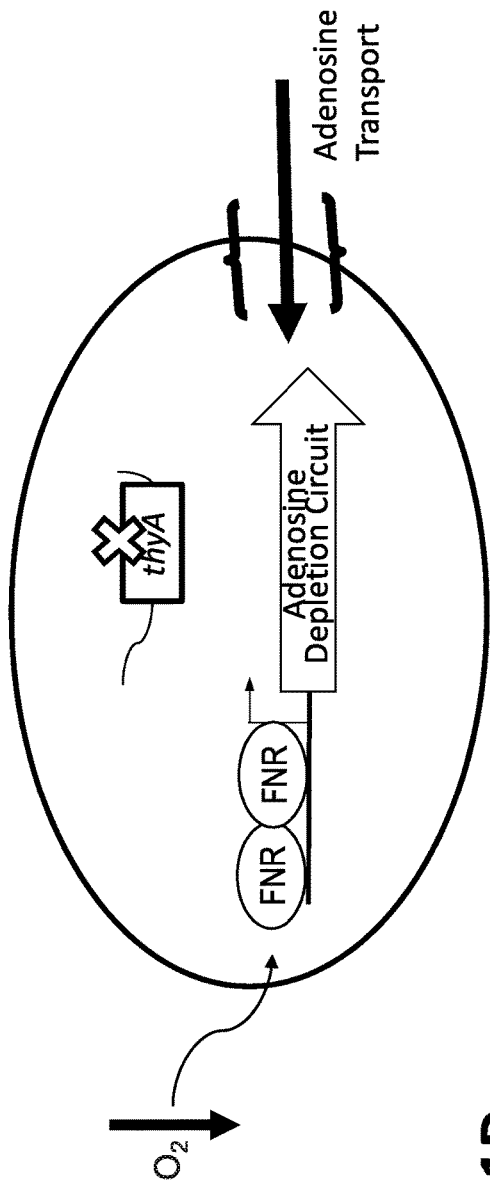
Figure 1E:
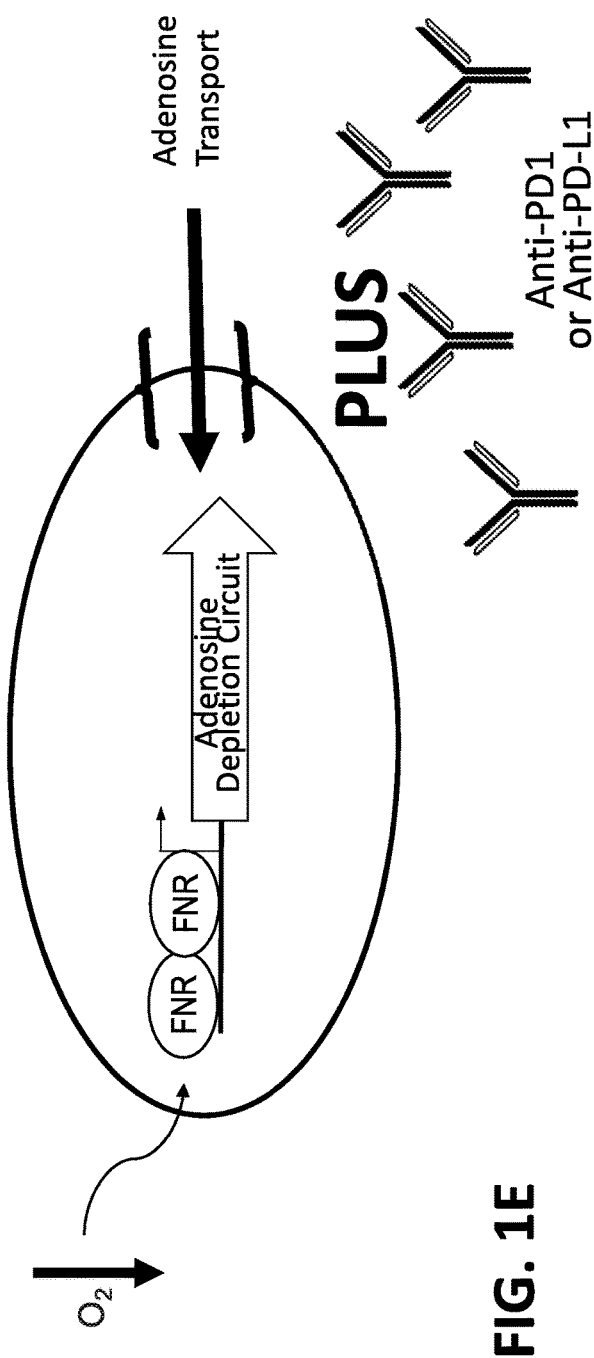
Figure 1F:
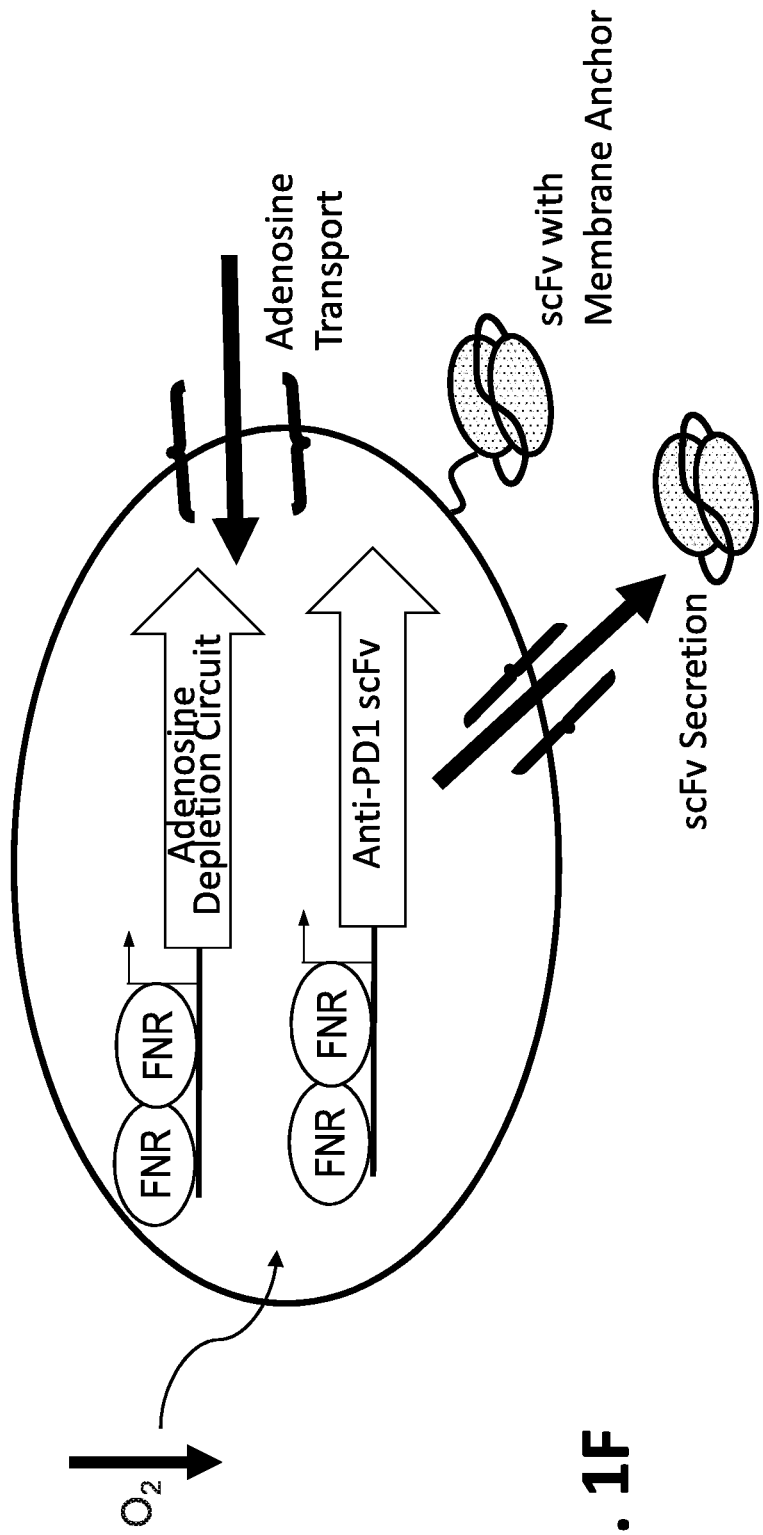
Figure 1G:
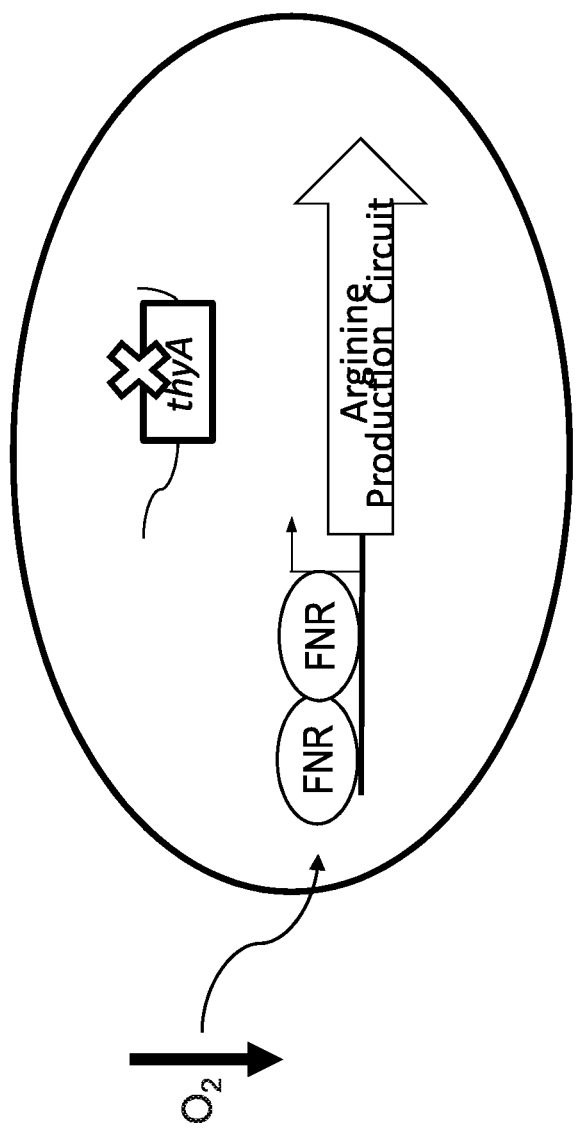
Figure 1H:
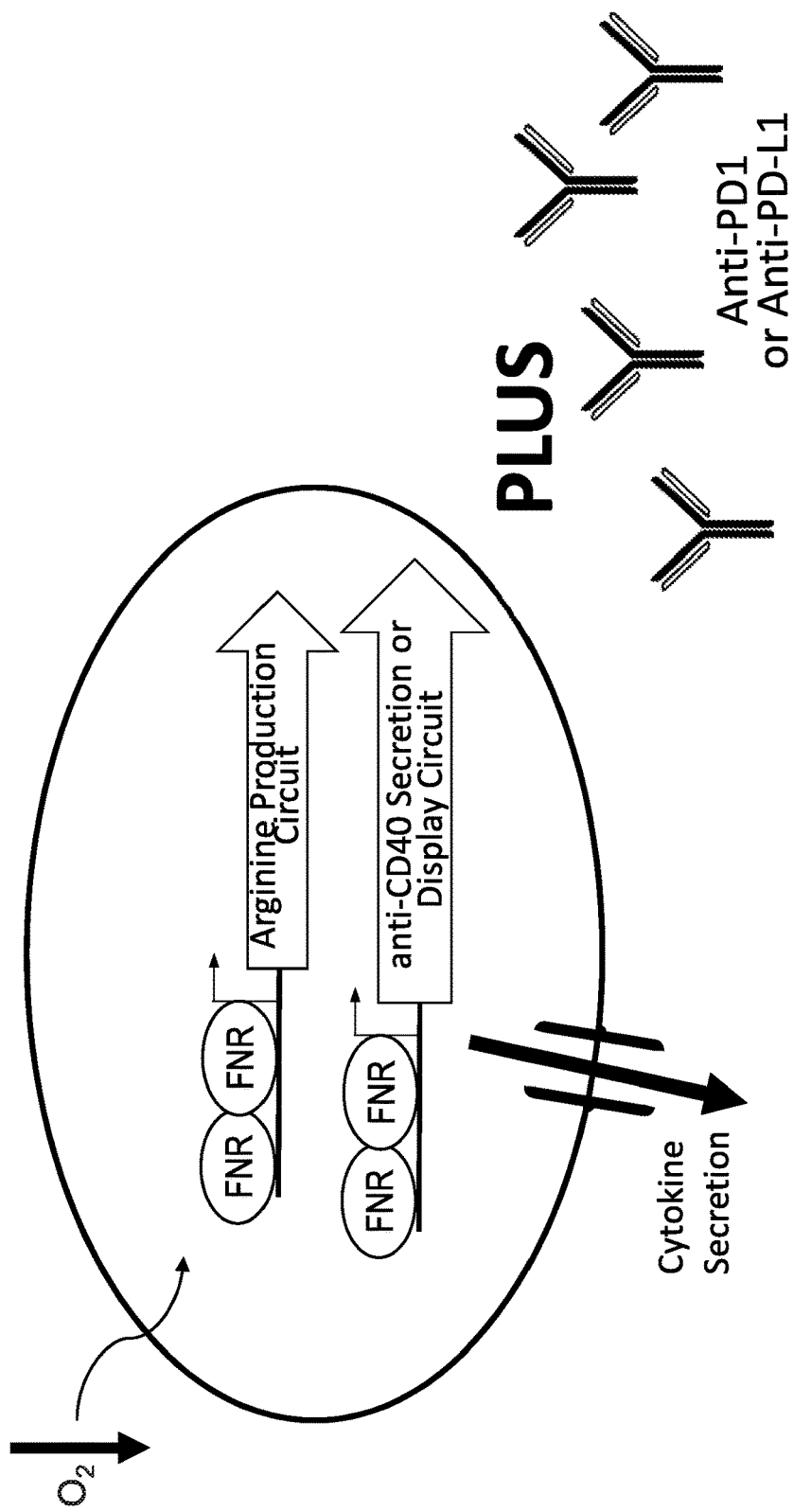
Figure 2A:
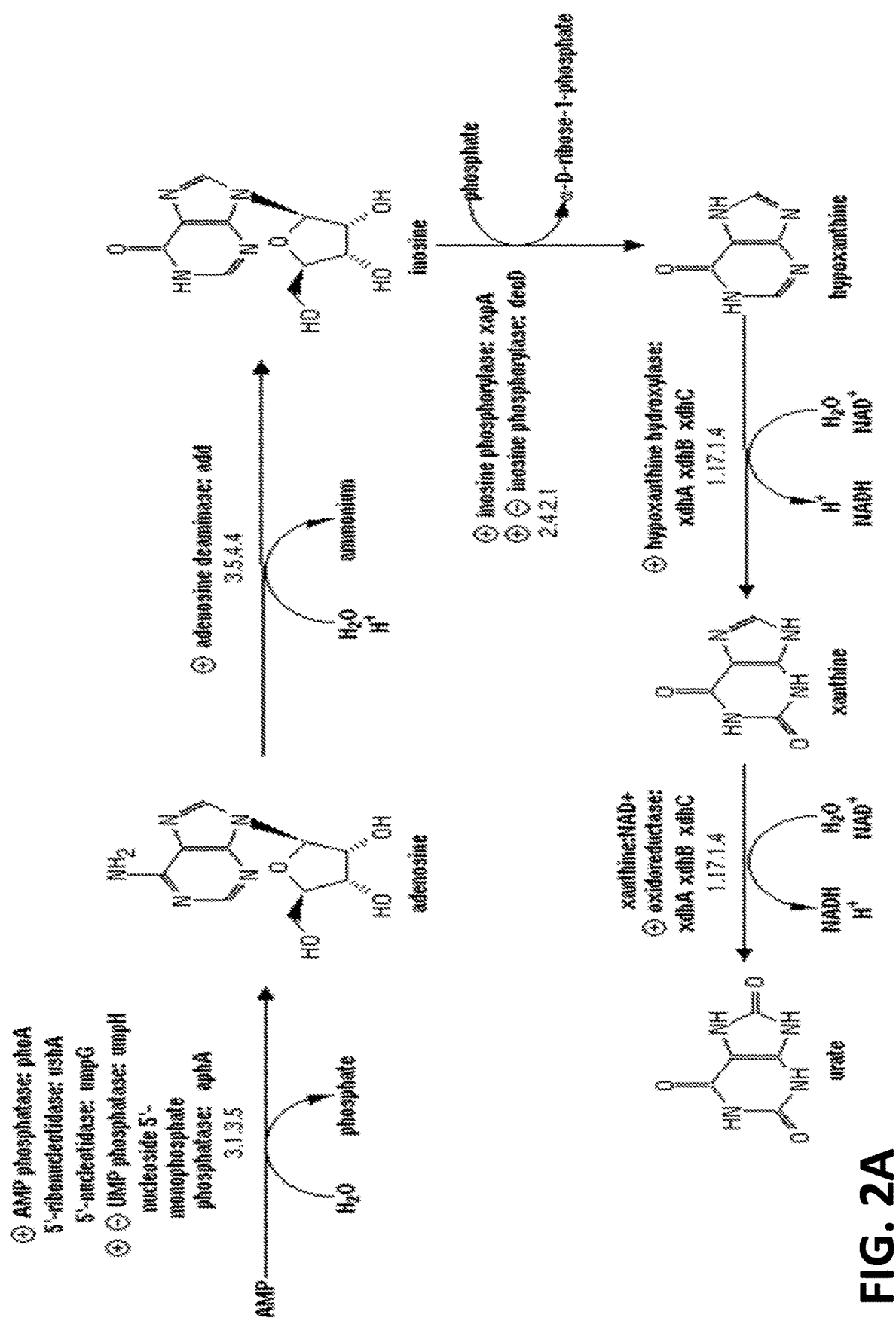
FIG. 2A and FIG. 2B show schematics depicting an adenosine degradation pathway and the corresponding bacterial pathway enzymes.
Figure 2B:
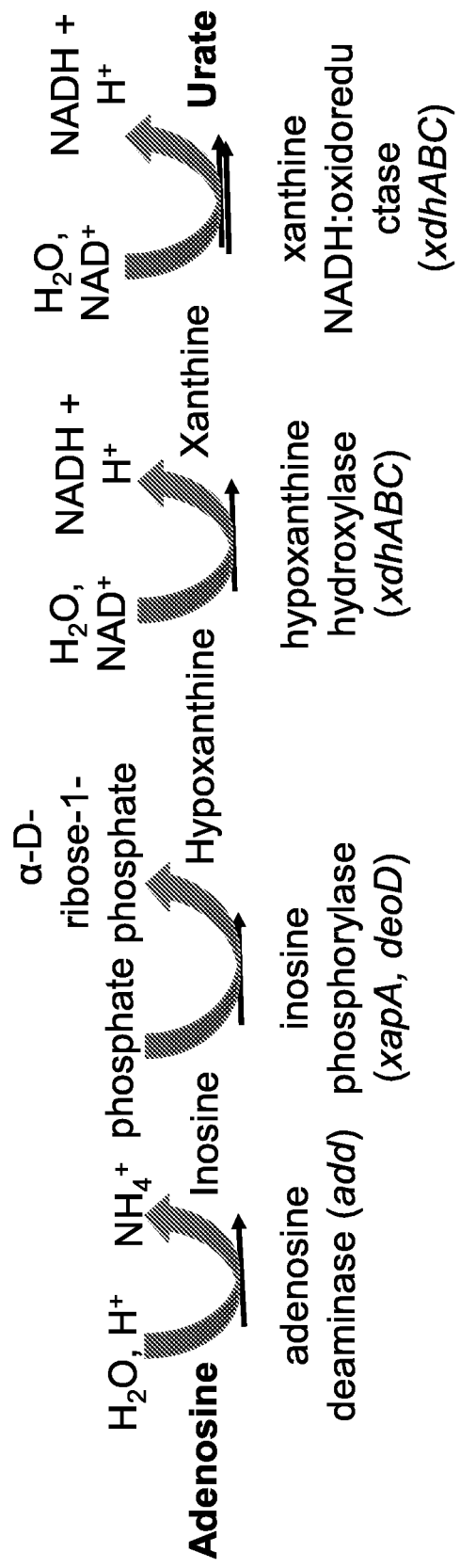
Figure 3:
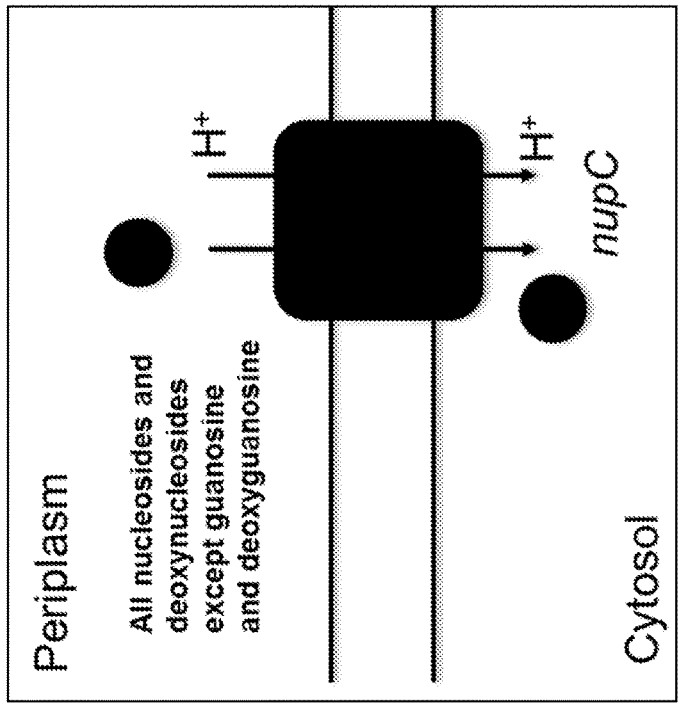
FIG. 3 depicts a schematic of the NupC, a nucleotide transporter of the H+/nucleotide symporter family. NupC pyrimidine nucleoside-H+ transporter mediates symport (i.e., H+-coupled substrate uptake) of nucleosides, particularly pyrimidines. Two known members of the family are found in gram positive and gram negative bacteria.
Figure 4A:
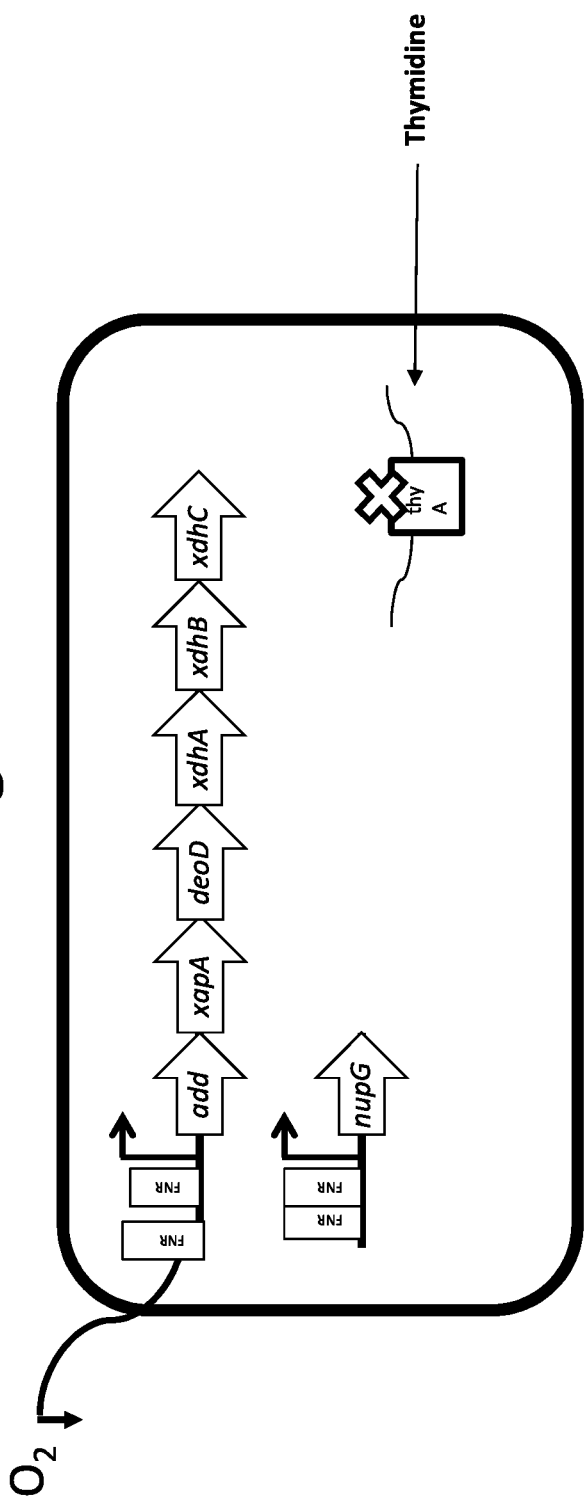
FIG. 4A and FIG. 4B depict schematics showing two exemplary gene organizations of an Adenosine Degradation Circuit. Adenosine is imported into the cell through expression of the E. coli Nucleoside Permease nupG transporter. Adenosine is converted to Inosine through expression of Adenine Deaminase add. Inosine is converted to hypoxyxanthine through expression of Inosine Phosphorylase, xapA, and deoD. Hypoxanthine is converted to Xanthine and Urate through expression of Hypoxanthine Hydroxylase, xdhA, xdhB, xdhC. Such circuits can be located one or more plasmids in the microorganism or can be integrated into the chromosome(s). In certain embodiments, the one or more circuits are under the control of inducible promoters known in the art or described herein. For example, such inducible promoters may be induced under low-oxygen conditions, such as an FNR promoter (depicted). In other embodiments, the promoters are induced in the presence of certain molecules or metabolites, e.g., in the presence of molecules or metabolites associated with the tumor microenvironment and/or with immune suppression. In some embodiments, the promoters are induced in certain tissue types. In some embodiments, promoters are induced in the presence of certain gut-specific molecules or metabolites. In some embodiments, the promoters are induced in the presence of some other metabolite that may or may not be present in the gut or the tumor, such as arabinose or another chemical or nutritional inducer known in the art or described herein. In certain embodiments, the one or more cassettes are under the control of constitutive promoters described herein or known in the art, e.g, whose expression can be fine-tuned using ribosome binding sites of different strengths. Such microorganisms optionally also comprise an auxotrophy, e.g., deltaThyA or deltaDapA.
Figure 4B:
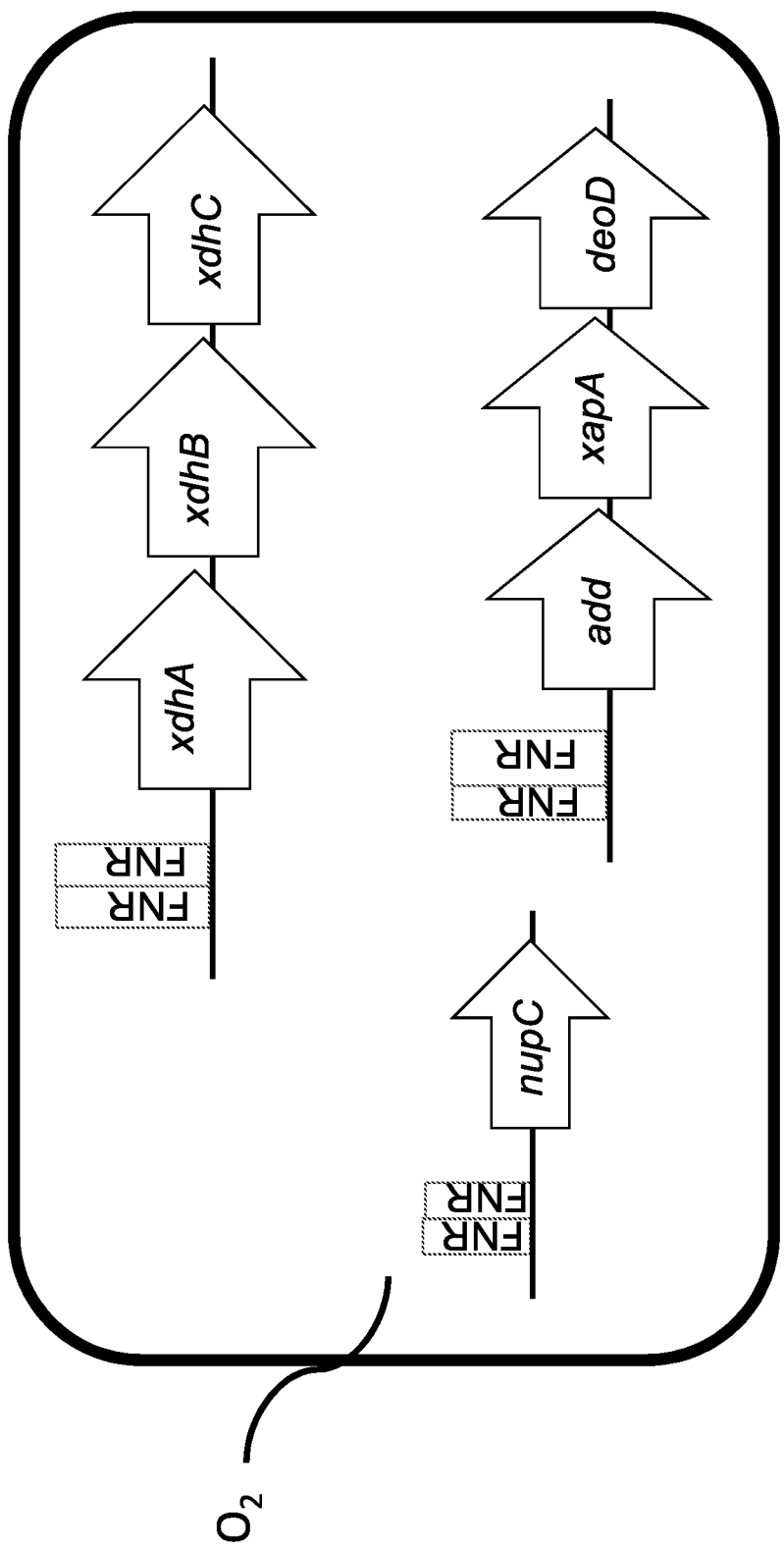

In some embodiments, the genetically engineered bacteria or genetically engineered oncolytic viruses comprise a means for metabolizing or degrading adenosine. In some embodiments, the genetically engineered bacteria or genetically engineered oncolytic virus comprise one or more gene sequences encoding one or more enzymes that are capable of converting adenosine to urate (See FIG. 2A-2B, FIG. 3, and FIGS. 4A-4B). In some embodiments, the genetically engineered bacteria or genetically engineered oncolytic viruses comprise sequence(s) encoding add, xapA, deoD, xdhA, xdhB, and xdhC genes from *E. coli*. In some embodiments, the genetically engineered bacteria or genetically engineered oncolytic viruses comprise sequence(s) encoding add, xapA, deoD, xdhA, xdhB, and xdhC genes from *E. coli* and comprise sequence encoding a nucleoside or adenosine transporter. In some embodiments, the genetically engineered bacteria or genetically engineered oncolytic viruses comprise sequence(s) encoding add, xapA, deoD, xdhA, xdhB, and xdhC genes from *E. coli* and comprise sequence encoding nupG or nupC. An exemplary engineered bacteria is shown in FIG. 4A and FIG. 4B.

Table 13 and Table 14 list exemplary sequences useful for adenosine degradation circuits.

TABLE 13

Adenosine Degradation Pathway Enzyme Polynucleotide Sequences

| Description | Sequence |
| --- | --- |
| nupC (polynucleotide) SEQ ID NO: 71 | GTGCACGGAAATTTAACCTGCCTCATATTTGGAGCAAATATGGACCG CGTCCTTCATTTTGTACTGGCACTTGCCGTTGTTGCGATTCTCGCACT GCTGGTAAGCAGCGACCGCAAAAAAATTCGTATCCGTTATGTTATTC AACTGCTTGTTATCGAAGTGTTACTGGCGTGGTTCTTCCTGAACTCCG ACGTTGGTCTGGGCTTCGTGAAAGGCTTCTCCGAAATGTTCGAAAAA CTGCTCGGTTTTGCCAACGAAGGGACTAACTTCGTCTTTGGTAGCATG AATGATCAAGGCCTGGCATTCTTCTTCCTGAAAGTGCTGTGCCCAATC GTCTTTATCTCTGCGCTGATCGGTATTCTCCAGCATATTCGCGTATTG CCGGTGATTATCCGCGCAATTGGTTTCCTGCTCTCCAAAGTCAACGGC ATGGGCAAACTGGAATCCTTTAACGCCGTCAGCTCCCTGATTCTGGG TCAGTCTGAAAACTTTATTGCCTATAAAGATATCCTCGGCAAAATCTC CCGCAATCGTATGTACACCATGGCAGCAACGGCGATGTCCACCGTGT CGATGTCCATCGTTGGTGCATATATGACCATGCTGGAGCCGAAATAC GTCGTTGCGGCGCTGGTACTGAACATGTTCAGCACCTTTATCGTGCTG TCGCTGATCAACCCTTACCGTGTTGATGCCAGTGAAGAAAACATTCA GATGTCCAACCTGCACGAAGGTCAGAGCTTCTTCGAAATGCTGGGTG AATACATTCTGGCAGGTTTCAAAGTTGCCATTATCGTTGCCGCGATGC TGATCGGCTTTATCGCCCTGATCGCTGCACTGAACGCTCTGTTTGCTA CCGTGACTGGCTGGTTTGGCTACAGCATCTCCTTCCAGGGCATCCTGG GTTACATCTTCTATCCGATTGCATGGGTGATGGGTGTTCCTTCCAGTG AAGCACTGCAAGTGGGCAGTATCATGGCGACCAAACTGGTTTCCAAC GAGTTCGTTGCGATGATGGATCTGCAGAAAATTGCTTCCACGCTCTCT CCGCGTGCGGAAGGCATCATCTCTGTGTTCCTGGTTTCCTTCGCTAAC TTCTCTTCAATCGGGATTATCGCGGGTGCGGTTAAAGGCCTGAATGA AGAGCAAGGTAACGTGGTTTCTCGCTTCGGTCTGAAACTGGTTTACG GCTCTACCCTGGTGAGTGTGCTGTCTGCGTCAATCGCAGCACTGGTGC TGTAA |
| xdhA SEQ ID NO: 72 | ATGCGCGTCGATGCCATTGCTAAGGTCACCGGGCGGGCACGATATAC TGACGATTATATTATGGCGGGCATGTGTTACGCGAAATATGTACGTA GCCCTATCGCACATGGTTATGCTGTAAATATTAATGATGAACAAGCC AGGAGTTTGCCGGGCGTCCTGGCGATTTTTACCTGGGAAGATGTGCC AGAAATCCCATTCGCCACGGCAGGGCATGCCTGGACACTTGACGAAA ACAAGCGCGATACCGCCGATCGTGCCCTGCTAACGCGTCATGTTCGT CATCATGGTGACGCCGTTGCCATCGTCGTGGCCCGCGATGAACTCAC GGCAGAAAAAGCGGCGCAATTGGTCAGCATTGAGTGGCAAGAATTA CCCGTTATCACCTCGCCAGAAGCGGCGCTGGCAGAAGACGCTGCACC AATCCATAACGGTGGCAATTTACTGAAACAAAGCACGATGTCGACGG GTAATGTCCAACAAACAATCGATGCCGCCGACTACCAGGTACAGGGG CACTATCAGACTCCCGTTATTCAACATTGTCATATGGAAAGCGTGAC ATCGCTGGCATGGATGGAGGATGACTCGCGAATTACCATCGTTTCCA GCACCCAGATCCCGCACATTGTTCGCCGCGTGGTTGGTCAGGCGCTG GATATTCCCTGGTCATGCGTACGAGTCATCAAACCGTTTATCGGTGGC GGTTTTGGTAATAAACAGGATGTACTGGAAGAGCCAATGGCGGCATT CCTGACCAGCAAACTTGGCGGCATTCCGGTGAAAGTTTCCCTTAGCC GTGAAGAGTGTTTCCTCGCAACCCGTACCCGCCACGCTTTTACTATTG ACGGGCAAATGGGCGTGAACCGCGACGGAACATTGAAAGGTTATAG TCTGGATGTTCTGTCTAACACCGGCGCTTATGCATCTCACGGGCACTC CATTGCTTCTGCTGGGGGGAATAAAGTCGCTTACCTTTATCCTCGTTG TGCCTACGCTTACAGTTCAAAGACCTGCTATACCAACCTCCCCTCGGC TGGTGCGATGCGTGGTTATGGCGCGCCACAAGTCGTATTTGCCGTTG AGTCTATGCTTGATGATGCCGCGACAGCGTTAGGTATTGATCCTGTTG AAATTCGTTTACGCAACGCCGCCCGCGAAGGAGATGCTAATCCGCTC ACGGGAAAACGTATTTACAGCGCAGGGTTGCCGGAGTGTCTTGAAAA AGGCCGGAAAATCTTTGAATGGGAAAAACGCCGTGCAGAGTGCCAG AACCAGCAAGGCAATTTACGTCGTGGCGTTGGCGTCGCCTGTTTTAG CTACACCTCTAACACCTGGCCTGTCGGCGTAGAAATAGCAGGCGCGC GCCTGTTGATGAATCAGGATGGAACCATCAACGTGCAAAGCGGCGCG ACGGAAATCGGCCAGGGTGCCGACACCGTGTTCTCGCAAATGGTGGC AGAAACCGTGGGAGTTCCGGTCAGCGATGTTCACGTTATTTCAACCC AAGATACCGACGTTACACCATTCGACCCCGGCGCATTTGCCTCACGT CAGAGCTATGTTGCCGCGCCTGCGCTGCGCAGTGCAGCACTGTTATT AAAAGAGAAAATCATCGCTCACGCCGCAGTCATGCTACATCAGTCAG CGATGAATCTGACCCTGATAAAAGGCCATATCGTGCTGATTGAAAGA CCGGAAGAACCGTTAATGTCGTTAAAAGATTTGGCGATGGACGCTTT CTACCACCCTGAACGCGGCGGGCAGCTCTCTGCCGAAAGCTCCATCA AAACCACCACTAACCCACCGGCGTTTGGCTGTACCTTTGTTGATCTGA |

TABLE 13-continued

Adenosine Degradation Pathway Enzyme
Polynuccleotide Sequences

| Description | Sequence |
|---|---|
|  | CGGTCGATATTGCACTGTGCAAAGTCACCATCAACCGCATCCTCAAC<br>GTTCATGATTCGGGCCATATTCTTAATCCGCTGCTGGCAGAAGGTCA<br>GGTACACGGCGGAATGGGAATGGGCATTGGCTGGGCGCTATTTGAAG<br>AGATGATCATCGATGCGAAAAGCGGCGTGGTCCGTAACCCCAATCTG<br>CTGGATTACAAAATGCCGACCATGCCGGATCTGCCACAACTGGAAAG<br>CGCGTTCGTCGAAATCAATGAGCCGCAATCAGCATACGGACATAAGT<br>CACTGGGTGAGCCCCCCATAATTCCTGTAGCCGCTGCTATTCGTAACG<br>CGGTGAAGATGGCTACCGGTGTTGCAATCAATACACTGCCGCTAACG<br>CCAAAACGATTATATGAAGAATTCCATCTGGCAGGATTGATTTGA |
| xdhB<br>SEQ ID<br>NO: 73 | ATGTTTGATTTTGCTTCTTACCATCGCGCAACCACCCTTGCCGATGCC<br>ATCACCCTGCTGGCTGACAATCCGCAGGCCAAATTGCTTGCCGGTGG<br>CACTGACGTACTGATACAGCTTCACCATCACAATGACCGCTATCGCC<br>ATATTGTTGATATCCACAATCTGGCAGAGCTTCAGGGAATAACACAG<br>GCGGAAGATGGCGCGCTGCGAATCGGCTCTGCGACAACATTTACTCA<br>GCTCATTGAAGATCCCGTAATCCAACGCAATCTCCCGGCGTTATGTG<br>CTGCGGCTGCATCAATCGCCGGGCCGCAGATCCGTAATGTCGCCACC<br>TACGGCGGAAATATTTGCAACGGTGCCACCAGCGCAGATTCTGCCAC<br>GCCAACGCTAATTTATGACGCGAAACTGGAGCTCCACTCCCCACGCG<br>GTGTTCGTTTCGTCCCGATTAATGGCTTTCACACCGGGCCGGGCAAA<br>GTGTCTCTTGAGCATGACGAAATCCTTGTCGCCTTTCATTTTCCGCCA<br>CAGCCGAAAGAACACGCGGGCAGCGCGCATTTTAAATATGCCATGCG<br>CGACGCAATGGATATTTCAACAATTGGCTGCGCCGCACATTGCCGAC<br>TGGATAACGGCCAATTTCAGCGAATTACGCCTGGCATTTGGTGTTGCC<br>GCGCCAACGCCGATTCGCTGCCAACATGCCGAACAGACTGCACAAAA<br>TGCGCCATTAAACCTGCAAACGCTGGAAGCCATCAGCGAATCAGTCC<br>TGCAAGATGTCGCCCCGCGTTCTTCATGGCGGGCCAGTAAAGAGTTT<br>CGTCTGCATCTCATCCAGACGATGACCAAAAAAGTGATTAGCGAAGC<br>CGTCGCCGCGGCGGGGGGAAAATTGCAATGA |
| xdhC<br>SEQ ID<br>NO: 74 | ATGAATCACAGCGAAACAATTACCATCGAATGCACCATTAACGGGAT<br>GCCTTTTCAGCTTCACGCCGCGCCAGGAATGCCGCTTTCGGAACTACT<br>CCGAGAACAAGGGCTTCTTAGTGTCAAACAAGGTTGCTGCGTAGGCG<br>AATGCGGTGCCTGTACGGTGCTGGTCGACGGCACTGCCGATAGACAGT<br>TGCTTATTCCTTGCGACCTGGGCTGAAGGAAAAGAGATCCGCACGCT<br>GGAAGGTGAAGCGAAAGGCGGTAAACTTTCTCATGTCCAACTGGCTT<br>ATGCGAAATCTGGTGCAGTGCAATGCGGGTTTTGTACGCCGGGCCTG<br>ATTATGGCTACCACGGCGATGCTGGCAAAACCACGCGAAAAACCATT<br>AACCATTACGGAAATTCGTCGTGGACTGGCGGGAAATCTTTGTCGCT<br>GCACGGGGTATCAGATGATTGTAAATACAGTTCTGGATTGCGAGAAA<br>ACGAAGTAA |
| Add<br>SEQ ID<br>NO: 75 | ATGATTGATACCACCCTGCCATTAACTGATATCCATCGCCACCTTGAT<br>GGCAACATTCGTCCCCAGACCATTCTTGAACTTGGCCGCCAGTATAA<br>TATCTCGCTTCCTGCACAATCCCTGGAAACACTGATTCCCCACGTTCA<br>GGTCATTGCCAACGAACCCGATCTGGTGAGCTTTCTGACTAAACTTG<br>ACTGGGGCGTTAAAGTTCTCGCCTCTCTTGATGCCTGCCGCCGCGTGG<br>CATTTGAAAACATTGAAGATGCAGCCCGTAACGGCCTGCACTATGTC<br>GAGCTGCGTTTTTCACCAGGCTACATGGCAATGGCACATCAGCTGCC<br>TGTAGCGGGTGTTGTCGAAGCGGTGATCGATGGCGTACGTGAAGGTT<br>GCCGCACCTTTGGTGTGCAGGCGAAGCTTATCGGTATTATGAGCCGG<br>ACCTTCGGCGAAGCCGCCTGTCAGCAAGAGCTGGAGGCCTTTTTAGC<br>CCACCGTGACCAGATTACCGCACTTGATTTAGCCGGTGATGAACTTG<br>GTTTCCCGGGAAGTCTGTTCCTTTCTCATTTCAACCGCGCGCGTGATG<br>CGGGCTGGCATATTACCGTCCATGCAGGCGAAGCTGCCGGACCGGAA<br>AGCATCTGGCAGGCGATTCGTGAACTGGGGCGGAGCGTATTGGACA<br>TGGCGTAAAAGCCATTGAAGATCGGGCGCTGATGGATTTTCTCGCCG<br>AGCAACAAATTGGTATTGAATCCTGTCTGACCTCCAATATTCAGACC<br>AGCACCGTGGCGGATCTGGCTGCACATCCGCTGAAAACGTTCCTTGA<br>GCATGGCATTCGTGCCAGCATTAACACTGACGATCCAGGCGTGCAGG<br>GAGTGGATATCATTCACGAATATACCGTTGCCGCGCCAGCTGCTGGG<br>TTATCCCGCGAGCAAATCCGCCAGGCACAGATTAATGGTCTGGAAAT<br>GGCTTTCCTCAGCGCAGAGGAAAAACGCGCACTGCGAGAAAAAGTC<br>GCCGCGAAGTAA |
| xapA<br>SEQ ID<br>NO: 76 | ATGTATCAGGCTCAGTTTTCTCATAACCCACTGTATTGCGTAGATATT<br>ATCAAGACTTATAAACCTGATTTCACGCCACGAGTGGCCTTTATTTTA<br>GGTTCCGGGCTGGGCGCGCTGGCCGATCAGATTGAGAACGCGGTCGC<br>AATTTCCTACGAAAAGCTGCCTGGGTTCCCGGTAAGTACCGTACACG<br>GTCATGCGGGTGAGCTGGTGCTGGGTTATCTCCAGGGGGTGCCAGTG<br>GCGTGTATGAAAGGTCGCGGACATTTCTACGAAGGTCGTGGGATGAC<br>CATCATGACGGATGCAATCCGTACCTTTAAGTTGCTGGGCGTGCGAGT<br>TGCTGTTCTGCACCAATGCGGCTGGCTCACTGCGCCCTGAAGTGGGG<br>GCCGGCAGTCTGGTCGCATTGAAAGATCACATCAACACCATGCCGGG<br>AACGCCGATGGTGGGTCTTAATGATGAACGTTTTGGTGAGCGCTTCTT |

TABLE 13-continued

Adenosine Degradation Pathway Enzyme
Polynuccleotide Sequences

| Description | Sequence |
|---|---|
| | CTCGCTGGCGAATGCCTACGATGCGGAATACCGCGCACTGTTACAAA<br>AAGTGGCGAAAGAAGAGGGGTTCCCTCTGACGGAGGGCGTGTTCGTC<br>TCATATCCGGGGCCGAATTTCGAGACTGCGGCGGAAATTCGCATGAT<br>GCAAATTATTGGTGGGGATGTTGTTGGTATGTCTGTGGTGCCTGAGGT<br>TATTTCAGCTCGCCATTGCGAACTTAAAGTCGTTGCGGTCTCTGCGAT<br>TACCAACATGGCGGAAGGTCTGAGTGACGTGAAGCTTTCTCATGCCC<br>AAACGCTGGCAGCAGCGGAACTCTCAAAGCAAAACTTTATTAATCTT<br>ATTTGCGGCTTTCTGCGCAAAATTGCCTGA |
| deoD<br>SEQ ID<br>NO: 77 | ATGGCTACCCCACACATTAATGCAGAAATGGGCGATTTCGCTGACGT<br>AGTTTTGATGCCAGGCGACCCGCTGCGTGCGAAGTATATTGCTGAAA<br>CTTTCCTTGAAGATGCCCGTGAAGTGAACAACGTTCGCGGTATGCTG<br>GGCTTCACCGGTACTTACAAAGGCCGCAAAATTTCCGTAATGGGTCA<br>CGGTATGGGTATCCCGTCCTGCTCCATCTACACCAAAGAACTGATCA<br>CCGATTTCGGCGTGAAGAAAATTATCCGCGTGGGTTCCTGTGGCGCA<br>GTTCTGCCGCACGTAAAACTACGCGACGTCGTTATCGGTATGGGTGC<br>CTGCACCGATTCCAAAGTTAACCGCATCCGTTTTAAAGACCATGACTT<br>TGCCGCTATCGCTGACTTTGACATGGTGCGTAACGCGGTAGACGCGG<br>CTAAAGCACTGGGCGTTGATGCTCGCGTGGGTAACCTGTTCTCCGCT<br>GACCTGTTCTACTCTCCGGACGGCGAAATGTTCGACGTGATGGAAAA<br>ATACGGCATCCTCGGCGTGGAAATGGAAGCGGCTGGTATCTACGGCG<br>TCGCTGCAGAATTTGGCGCGAAAGCCCTGACCATCTGCACCGTGTCT<br>GACCACATCCGCACTCACGAGCAGACCACTGCCGCTGAGCGTCAGAC<br>CACCTTCAACGACATGATCAAAATCGCACTGGAATCCGTTCTGCTGG<br>GCGATAAAGAGTAA |

In some embodiments, genetically engineered bacteria comprise a nucleic acid sequence that is at least about 80%, at least about 85%, at least about 90%, at least about 95%, or at least about 99% homologous to the DNA sequence of SEQ ID NO: 71, SEQ ID NO: 72, SEQ ID NO: 73, SEQ ID NO: 74, SEQ ID NO: 75, SEQ ID NO: 76, and/or SEQ ID NO: 77.

TABLE 14

Adenosine Degradation Pathway Enzyme Polypeptide Sequences

| Description | Sequence |
|---|---|
| NupC<br>(polypeptide)<br>SEQ ID<br>NO: 78 | VHGNLTCLIFGANMDRVLHFVLALAVVAILALLVSSDRKKIRIRYVI<br>QLLVIEVLLAWFFLNSDVGLGFVKGFSEMFEKLLGFANEGTNFVFGS<br>MNDQGLAFFFLKVLCPIVFISALIGILQHIRVLPVIIRAIGFLLSKVNG<br>MGKLESFNAVSSLILGQSENFIAYKDILGKISRNRMYTMAATAMSTV<br>SMSIVGAYMTMLEPKYVVAALVLNMFSTFIVLSLINPYRVDASEENI<br>QMSNLHEGQSFFEMLGEYILAGFKVAIIVAAMLIGFIALIAALNALFA<br>TVTGWFGYSISFQGILGYIFYPIAWVMGVPSSEALQVGSIMATKLVS<br>NEFVAMMDLQKIASTLSPRAEGIISVFLVSFANFSSIGIIAGAVKGLNE<br>EQGNVVSRFGLKLVYGSTLVSVLSASIAALVL |
| xdhA<br>(polypeptide)<br>SEQ ID<br>NO: 79 | MRVDAIAKVTGRARYTDDYIMAGMCYAKYVRSPIAHGYAVNINDE<br>QARSLPGVLAIFTWEDVPEIPFATAGHAWTLDENKRDTADRALLTR<br>HVRHHGDAVAIVVARDELTAEKAAQLVSIEWQELPVITSPEAALAE<br>DAAPIHNGGNLLKQSTMSTGNVQQTIDAADYQVQGHYQTPVIQHC<br>HMESVTSLAWMEDDSRITIVSSTQIPHIVRRVVGQALDIPWSCVRVIK<br>PFIGGGFGNKQDVLEEPMAAFLTSKLGGIPVKVSLSREECFLATRTR<br>HAFTIDGQMGVNRDGTLKGYSLDVLSNTGAYASHGHSIASAGGNK<br>VAYLYPRCAYAYSSKTCYTNLPSAGAMRGYGAPQVVFAVESMLDD<br>AATALGIDPVEIRLRNAAREGDANPLTGKRIYSAGLPECLEKGRKIFE<br>WEKRRAECQNQQGNLRRGVGVACFSYTSNTWPVGVEIAGARLLM<br>NQDGTINVQSGATEIGQGADTVFSQMVAETVGVPVSDVHVISTQDT<br>DVTPFDPGAFASRQSYVAAPALRSAALLLKEKIIAHAAVMLHQSAM<br>NLTLIKGHIVLIERPEEPLMSLKDLAMDAFYHPERGGQLSAESSIKTT<br>TNPPAFGCTFVDLTVDIALCKVTINRILNVHDSGHILNPLLAEGQVHG<br>GMGMGIGWALFEEMIIDAKSGVVRNPNLLDYKMPTMPDLPQLESAF<br>VEINEPQSAYGHKSLGEPPIIPVAAAIRNAVKMATGVAINTLPLTPKR<br>LYEEFHLAGLI* |
| xdhB<br>(polypeptide)<br>SEQ ID | MFDFASYHRATTLADAITLLADNPQAKLLAGGTDVLIQLHHHNDRY<br>RHIVDIHNLAELQGITQAEDGALRIGSATTFTQLIEDPVIQRNLPALCA<br>AAASIAGPQIRNVATYGGNICNGATSADSATPTLIYDAKLELHSPRG |

TABLE 14-continued

Adenosine Degradation Pathway Enzyme Polypeptide Sequences

| Description | Sequence |
|---|---|
| NO: 80 | VRFVPINGFHTGPGKVSLEHDEILVAFHFPPQPKEHAGSAHFKYAMR<br>DAMDISTIGCAAHCRLDNGNFSELRLAFGVAAPTPIRCQHAEQTAQN<br>APLNLQTLEAISESVLQDVAPRSSWRASKEFRLHLIQTMTKKVISEA<br>VAAAGGKLQ* |
| xdhC<br>(polypeptide)<br>SEQ ID<br>NO: 81 | MFDFASYHRATTLADAITLLADNPQAKLLAGGTDVLIQLHHHNDRY<br>RHIVDIHNLAELQGITQAEDGALRIGSATTFTQLIEDPVIQRNLPALCA<br>AAASIAGPQIRNVATYGGNICNGATSADSATPTLIYDAKLELHSPRG<br>VRFVPINGFHTGPGKVSLEHDEILVAFHFPPQPKEHAGSAHFKYAMR<br>DAMDISTIGCAAHCRLDNGNFSELRLAFGVAAPTPIRCQHAEQTAQN<br>APLNLQTLEAISESVLQDVAPRSSWRASKEFRLHLIQTMTKKVISEA<br>VAAAGGKLQ* |
| Add<br>(polypeptide)<br>SEQ ID<br>NO: 82 | MIDTTLPLTDIHRHLDGNIRPQTILELGRQYNISLPAQSLETLIPHVQVI<br>ANEPDLVSFLTKLDWGVKVLASLDACRRVAFENIEDAARNGLHYV<br>ELRFSPGYMAMAHQLPVAGVVEAVIDGVREGCRTFGVQAKLIGIMS<br>RTFGEAACQQELEAFLAHRDQITALDLAGDELGFPGSLFLSHFNRAR<br>DAGWHITVHAGEAAGPESIWQAIRELGAERIGHGVKAIEDRALMDF<br>LAEQQIGIESCLTSNIQTSTVADLAAHPLKTFLEHGIRASINTDDPGVQ<br>GVDIIHEYTVAAPAAGLSREQIRQAQINGLEMAFLSAEEKRALREKV<br>AAK* |
| xapA<br>(polypeptide)<br>SEQ ID<br>NO: 83 | MYQAQFSHNPLYCVDIIKTYKPDFTPRVAFILGSGLGALADQIENAV<br>AISYEKLPGFPVSTVHGHAGELVLGYLQGVPVACMKGRGHFYEGR<br>GMTIMTDAIRTFKLLGCELLFCTNAAGSLRPEVGAGSLVALKDHINT<br>MPGTPMVGLNDERFGERFFSLANAYDAEYRALLQKVAKEEGFPLTE<br>GVFVSYPGPNFETAAEIRMMQIIGGDVVGMSVVPEVISARHCELKVV<br>AVSAITNMAEGLSDVKLSHAQTLAAAELSKQNFINLICGFLRKIA* |
| deoD<br>(polypeptide)<br>SEQ ID<br>NO: 84 | MATPHINAEMGDFADVVLMPGDPLRAKYIAETFLEDAREVNNVRG<br>MLGFTGTYKGRKISVMGHGMGIPSCSIYTKELITDFGVKKIIRVGSCG<br>AVLPHVKLRDVVIGMGACTDSKVNRIRFKDHDFAAIADFDMVRNA<br>VDAAKALGVDARVGNLFSADLFYSPDGEMFDVMEKYGILGVEMEA<br>AGIYGVAAEFGAKALTICTVSDHIRTHEQTTAAERQTTFNDMIKIAL<br>ESVLLGDKE* |

In some embodiments, genetically engineered bacteria comprise a nucleic acid sequence that encodes a polypeptide which is at least about 80%, at least about 85%, at least about 90%, at least about 95%, or at least about 99% homologous to the DNA sequence of SEQ ID NO: 78, SEQ ID NO: 79, SEQ ID NO: 80, SEQ ID NO: 81, SEQ ID NO: 82, SEQ ID NO: 83, and/or SEQ ID NO: 84.

Data described herein suggest anti-tumor activity of adenosine-consuming strains described herein bother alone and in combination with an anti-PD1 and/or PD-L1 antibody.

In some embodiments, the genetically engineered microorganisms are capable of expressing any one or more of the described circuits for the degradation of adenosine in low-oxygen conditions, and/or in the presence of cancer and/or the tumor microenvironment, or tissue specific molecules or metabolites, and/or in the presence of molecules or metabolites associated with inflammation or immune suppression, and/or in the presence of metabolites that may be present in the gut, and/or in the presence of metabolites that may or may not be present in vivo, and may be present in vitro during strain culture, expansion, production and/or manufacture, such as arabinose and others described herein. In some embodiments, the gene sequences(s) encoding circuitry for the degradation of adenosine are controlled by a promoter inducible by such conditions and/or inducers. In some embodiments, the gene sequences(s) are controlled by a constitutive promoter, as described herein. In some embodiments, the gene sequences(s) are controlled by a constitutive promoter, and are expressed in in vivo conditions and/or in vitro conditions, e.g., during expansion, production and/or manufacture, as described herein.

In some embodiments, any one or more of the described adenosine degradation circuits are present on one or more plasmids (e.g., high copy or low copy) or are integrated into one or more sites in the microorganisms' chromosome. Also, in some embodiments, the genetically engineered microorganisms are further capable of expressing any one or more of the described circuits and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, (6) one or more surface display circuits, such as any of the surface display circuits described herein and otherwise known in the art and (7) one or more circuits for the production or degradation of one or more metabolites (e.g., kynurenine, tryptophan, adenosine, arginine) described herein (8) combinations of one or more of such additional circuits.

In some embodiments, the genetically engineered bacteria or genetically engineered oncolytic viruses comprise a means for increasing the level of ATP in the tumor microenvironment, e.g., by increasing the production and secretion of ATP from the microorganism. In some embodiments, the genetically engineered bacteria or genetically engineered oncolytic viruses comprise one or more means for reducing the levels of adenosine in the tumor microenvironment (e.g., by increasing the uptake of adenosine, by metabolizing and/or degrading adenosine), increasing the levels of ATP in the tumor microenvironment, and/or preventing or blocking the conversion of ATP to adenosine in the tumor microenvironment. In any of these embodiments, the genetically engineered bacterium or genetically engineered oncolytic virus is a tumor-targeting bacterium or tumor-targeting oncolytic virus. In some embodiments, the genetically engineered bacterium or genetically engineered oncolytic virus comprises one or more genes for metabolizing adenosine, under the control of a promoter that is activated by low-oxygen conditions, by hypoxic conditions, or by inflammatory conditions, such as any of the promoters activated by said conditions and described herein. In some embodiments, the genetically engineered bacteria or genetically engineered OV expresses one or more genes for metabolizing adenosine under the control of a cancer-specific promoter, a tissue-specific promoter, or a constitutive promoter, such as any of the promoters described herein.

Arginine/Arginase I Metabolism

L-Arginine (L-Arg) is a nonessential amino acid that plays a central role in several biological systems including the immune response. The importance of L-Arg on the immune response was initially suggested by the association between impaired T-cell function and a reduction in serum L-Arg levels found in patients and rodents after liver transplantation or trauma, a process that was rapidly reversed by the supplementation of L-Arg. T cells cultured in the absence of L-Arg lose CD3 expression and are unable to proliferate. Notably, T cells that infiltrate tumors also have been observed to have a decreased expression of signal transduction proteins, a diminished ability to proliferate, and a decreased production of cytokines.

L-Arginine is metabolized by arginase I, arginase II, and the inducible nitric oxide synthase. Arginase 1 hydrolyzes L-Arginine into urea and L-ornithine, the latter being the main substrate for the production of polyamines (putrescine, spermidine, and spermine) that are required for cell cycle progression. High arginase activity has been observed in patients with various malignancies including gastric, colon, breast, and lung cancers and has also been associated with the need for malignant cells to produce polyamines to sustain their rapid proliferation.

Recent studies have revealed a distinct subpopulation of tumor-infiltrating myeloid cells, and not tumor cells, that produce high levels of arginase I and cationic amino acid transporter 2B, which allow them to rapidly incorporate L-Arginine (L-Arg) and deplete extracellular L-Arg the tumor microenvironment. These cells are potent inhibitors of T-cell receptor expression and antigen-specific T-cell responses. These cells have also been shown to be potent inducers of regulatory T cells. Other cells within the tumor microenvironment including the malignant cells, T lymphocytes, and even other myeloid subpopulations did not produce arginase I and did not impair T-cell function. Therefore, it is thought that these tumor-infiltrating myeloid cells represent a unique subpopulation with the ability to suppress the protective immune response through various mechanisms. In addition, the almost complete inhibition of the suppressive function of these tumor-associated myeloid cells by an Arginase inhibitor suggested that arginase I may represent one of the principal mechanisms used by these cells to impair T-cell function. Therefore, the increase in arginase I expression may not only facilitate tumor growth, but may also have as a secondary effect, the local reduction of L-Arg levels allowing tumors to escape the immune response.

In addition, MDSC inhibit effectively antitumoral adaptive immune responses mainly by the production of reactive oxygen intermediates and by the expression of the arginine-metabolizing enzymes nitric oxide synthase and arginase. Two mammalian arginase isoforms exist, which both hydrolyze arginine to ornithine and urea. MDSC can suppress T cell immune functions by constitutive expression of arginase with consecutive L-arginine depletion. Arginase I-mediated arginine depletion in the tumor microenvironment leads to inhibition of T lymphocyte proliferation, cytokine synthesis and anti-tumor immune responses. In human T lymphocytes, the absence of arginine induces a downregulation of the signal transducing T cell receptor-associated chain, impairs dephosphorylation of the actin-binding protein cofilin and inhibits progression through the cell cycle via induction of a G0-G1 arrest. In addition, MDSC-derived iNOS converts L-arginine to citrulline and NO, which suppresses T cell function through inhibition of Jak/STAT signaling, reducing MHC class II expression and inducing T cell apoptosis (Munder, Br J Pharmacol. 2009 October; 158(3): 638-651. Arginase: an emerging key player in the mammalian immune system). Thus, the development of arginase inhibitors for clinical use is of prime importance in light of all the accumulated data on the role of arginase in tumor-associated MDSC and its pathogenetic role in inflammation-induced immunosuppression.

Thus, in certain embodiments, the engineered microorganisms of the present disclosure, e.g., engineered bacteria and engineered oncolytic viruses, are able to deplete or decrease the levels of arginase I found in the tumor microenvironment. As discussed, L-Arginine is metabolized by arginase I, which hydrolyzes L-Arginine into urea and L-ornithine. Thus, the level of arginase I can be depleted by the addition of L-Arginine to the tumor microenvironment. Moreover, several studies have shown that L-Arginine serves as an effective inhibitor of arginase I. (Rodriguez et al., Arginase I Production in the Tumor Microenvironment by Mature Myeloid Cells Inhibits T-Cell Receptor Expression and Antigen-Specific T-Cell Responses, 2004, Can Res, 64:5839). Thus, in certain embodiments, the engineered microorganisms of the present disclosure, e.g., engineered bacteria and engineered oncolytic viruses, are able to produce L-Arginine. Microrganisms, genetic circuits for engineering, and methods for engineering microorganisms to produce arginine are provided in U.S. Ser. No. 14/960,333 and PCT/US2015/064140, the contents of which are hereby incorporated by references in their entireties, including the drawings.

In some embodiments, the genetically engineered bacteria or genetically engineered oncolytic viruses that produce L-Arginine comprise one or more gene sequences encoding one or more enzymes of the L-Arginine biosynthetic pathway. In some embodiments, the genetically engineered bacteria or engineered oncolytic viruses comprise one or more gene sequences encoding one or more enzymes that are capable of converting glutamate to arginine. In some embodiments, the genetically engineered bacteria or engineered oncolytic viruses comprise an Arginine operon. In some embodiments, the genetically engineered bacteria or engineered oncolytic viruses comprise the Arginine operon of *E. coli*, as described in detail below. In some embodiments, the genetically engineered bacteria or engineered oncolytic viruses comprise the Arginine operon of another bacteria as described in detail below. In any of these embodiments, the arginine repressor (ArgR) optionally may be deleted, mutated, or modified so as to diminish or obliterate its repressor function.

In bacteria such as *Escherichia coli* (*E. coli*), the arginine biosynthesis pathway is capable of converting glutamate to arginine in an eight-step enzymatic process involving the enzymes N-acetylglutamate synthetase, N-acetylglutamate kinase, N-acetylglutamate phosphate reductase, acetylornithine aminotransferase, N-acetylornithinase, carbamoylphosphate synthase, ornithine transcarbamylase, argininosuccinate synthase, and argininosuccinate lyase (Cunin et al., 1986). The first five steps involve N-acetylation to generate an ornithine precursor. In the sixth step, ornithine transcarbamylase (also known as ornithine carbamoyltransferase) catalyzes the formation of citrulline. The final two steps involve carbamoylphosphate utilization to generate arginine from citrulline.

ArgA encodes N-acetylglutamate synthetase, argB encodes N-acetylglutamate kinase, argC encodes N-acetylglutamylphosphate reductase, argD encodes acetylornithine aminotransferase, argE encodes N-acetylornithinase, argF encodes ornithine transcarbamylase, argI also encodes ornithine transcarbamylase, argG encodes argininosuccinate synthase, argH encodes argininosuccinate lyase, and argJ encodes ornithine acetyltransferase. CarA encodes the small A subunit of carbamoylphosphate synthase having glutaminase activity, and carB encodes the large B subunit of carbamoylphosphate synthase that catalyzes carbamoylphosphate synthesis from ammonia. Different combinations of one or more of these arginine biosynthesis genes (i.e., argA, argB, argC, argD, argE, argF, argG, argH, argI, argJ, carA, and carB) may be organized, naturally or synthetically, into one or more operons, and such organization may vary between bacterial species, strains, and subtypes. The regulatory region of each operon contains at least one ARG box, and the number of ARG boxes per regulatory region may vary between operons and bacteria.

All of the genes encoding these enzymes are subject to repression by arginine via its interaction with ArgR to form a complex that binds to the regulatory region of each gene and inhibits transcription. N-acetylglutamate synthetase is also subject to allosteric feedback inhibition at the protein level by arginine alone (Tuchman et al., 1997; Caldara et al., 2006; Caldara et al., 2008; Caldovic et al., 2010).

The genes that regulate arginine biosynthesis in bacteria are scattered across the chromosome and organized into multiple operons that are controlled by a single repressor, which Maas and Clark (1964) termed a "regulon." Each operon is regulated by a regulatory region comprising at least one 18-nucleotide imperfect palindromic sequence, called an ARG box, that overlaps with the promoter and to which the repressor protein binds (Tian et al., 1992; Tian et al., 1994). The argR gene encodes the repressor protein, which binds to one or more ARG boxes (Lim et al., 1987). Arginine functions as a corepressor that activates the arginine repressor. The ARG boxes that regulate each operon may be non-identical, and the consensus ARG box sequence is A/T nTGAAT A/T A/T T/A T/A ATTCAn T/A (Maas, 1994). In addition, the regulatory region of argR contains two promoters, one of which overlaps with two ARG boxes and is autoregulated.

In some embodiments, the genetically engineered bacteria or genetically engineered oncolytic virus comprise a mutant arginine regulon and produce more arginine, than unmodified bacteria or virus of the same subtype under the same conditions. The mutant arginine regulon comprises one or more nucleic acid mutations that reduce or prevent arginine-mediated repression—via ArgR binding to ARG boxes and/or arginine binding to N-acetylglutamate synthetase—of one or more of the operons that encode the enzymes responsible for converting glutamate to arginine in the arginine biosynthesis pathway, thereby enhancing arginine and/or intermediate byproduct biosynthesis.

In some engineered bacteria or engineered virus, the arginine regulon includes, but is not limited to, argA, encoding N-acetylglutamate synthetase; argB, encoding N-acetylglutamate kinase; argC, encoding N-acetylglutamylphosphate reductase; argD, encoding acetylornithine aminotransferase; argE, encoding N-acetylornithinase; argG, encoding argininosuccinate synthase; argH, encoding argininosuccinate lyase; one or both of argF and argI, each of which independently encodes ornithine transcarbamylase; carA, encoding the small subunit of carbamoylphosphate synthase; carB, encoding the large subunit of carbamoylphosphate synthase; operons thereof; operators thereof; promoters thereof; ARG boxes thereof; and/or regulatory regions thereof. In some embodiments, the arginine regulon comprises argJ, encoding ornithine acetyltransferase (either in addition to or in lieu of N-acetylglutamate synthetase and/or N-acetylornithinase), operons thereof, operators thereof, promoters thereof, ARG boxes thereof, and/or regulatory regions thereof.

In some embodiments, the genetically engineered bacteria or genetically engineered viruses comprise an arginine biosynthesis pathway and are capable of producing arginine. In a more specific aspect, the genetically engineered bacteria or genetically engineered viruses comprise a mutant arginine regulon in which one or more operons encoding arginine biosynthesis enzyme(s) is derepressed to produce more arginine than unmodified bacteria of the same subtype under the same conditions. In some embodiments, the genetically engineered bacteria or genetically engineered viruses overproduce arginine.

One of skill in the art would appreciate that the organization of arginine biosynthesis genes within an operon varies across species, strains, and subtypes of bacteria, e.g., bipolar argECBH in *E. coli* K12, argCAEBD-carAB-argF in *B. subtilis*, and bipolar carAB-argCJBDF in *L. plantarum*. Non-limiting examples of operon organization from different bacteria are shown in the Table 15 below (in some instances, the genes are putative and/or identified by sequence homology to known sequences in *Escherichia coli*; in some instances, not all of the genes in the arginine regulon are known and/or shown below). In certain instances, the arginine biosynthesis enzymes vary across species, strains, and subtypes of bacteria.

TABLE 15

Examples of arg operon organization

| Bacteria | Operon organization | | | | | |
|---|---|---|---|---|---|---|
| *Escherichia coli* Nissle | argA | bipolar argECBH | argD | argI | argG | carAB |

TABLE 15-continued

Examples of arg operon organization

| Bacteria | Operon organization | | | | | |
|---|---|---|---|---|---|---|
| Bacteroides | argRGCD | argF | argB | argE | carAB | |
| Clostridium | argR | | argGH | | | argI |
| Bacillus subtilis | argGH | | argCAEBD-carAB-argF | | | |
| Bacillus subtilis | argGH | | argCJBD-carAB-argF | | | |
| Lactobacillus plantarum | argGH | | bipolar carAB-argCJBDF | | | |
| Lactococcus | argE | carA | carB | argGH | argFBDJC | |

Each operon is regulated by a regulatory region comprising at least one promoter and at least one ARG box, which control repression and expression of the arginine biosynthesis genes in said operon.

In some embodiments, the genetically engineered bacteria or genetically engineered viruses comprise an arginine regulon comprising one or more nucleic acid mutations that reduce or eliminate arginine-mediated repression of one or more of the operons that encode the enzymes responsible for converting glutamate to arginine in the arginine biosynthesis pathway. Reducing or eliminating arginine-mediated repression may be achieved by reducing or eliminating ArgR repressor binding (e.g., by mutating or deleting the arginine repressor or by mutating at least one ARG box for each of the operons that encode the arginine biosynthesis enzymes) and/or arginine binding to N-acetylglutamate synthetase (e.g., by mutating the N-acetylglutamate synthetase to produce an arginine feedback resistant N-acetylglutamate synthase mutant, e.g., argAfbr).

ARG Box

In some embodiments, the genetically engineered bacteria or genetically engineered viruses comprise a mutant arginine regulon comprising one or more nucleic acid mutations in at least one ARG box for one or more of the operons that encode the arginine biosynthesis enzymes N-acetylglutamate kinase, N-acetylglutamylphosphate reductase, acetylornithine aminotransferase, N-acetylornithinase, ornithine transcarbamylase, argininosuccinate synthase, argininosuccinate lyase, and carbamoylphosphate synthase, thereby derepressing the regulon and enhancing arginine and/or intermediate byproduct biosynthesis. In some embodiments, the genetically engineered bacteria comprise a mutant arginine repressor comprising one or more nucleic acid mutations such that arginine repressor function is decreased or inactive, or the genetically engineered bacteria do not have an arginine repressor (e.g., the arginine repressor gene has been deleted), resulting in derepression of the regulon and enhancement of arginine and/or intermediate byproduct biosynthesis. In either of these embodiments, the genetically engineered bacteria or genetically engineered viruses may further comprise an arginine feedback resistant N-acetylglutamate synthase mutant, e.g., argAfbr. Thus, in some embodiments, the genetically engineered bacteria or genetically engineered viruses comprise a mutant arginine regulon comprising one or more nucleic acid mutations in at least one ARG box for one or more of the operons that encode the arginine biosynthesis enzymes and an arginine feedback resistant N-acetylglutamate synthase mutant, e.g., argA$^{fbr}$. In some embodiments, the genetically engineered bacteria or genetically engineered viruses comprise a mutant or deleted arginine repressor and an arginine feedback resistant N-acetylglutamate synthase mutant, e.g., argA$^{fbr}$. In some embodiments, the genetically engineered bacteria comprise an arginine feedback resistant N-acetylglutamate synthase mutant, e.g., argA$^{fbr}$, a mutant arginine regulon comprising one or more nucleic acid mutations in at least one ARG box for each of the operons that encode the arginine biosynthesis enzymes, and/or a mutant or deleted arginine repressor.

In some embodiments, the genetically engineered bacteria or genetically engineered viruses encode an arginine feedback resistant N-acetylglutamate synthase and further comprise a mutant arginine regulon comprising one or more nucleic acid mutations in each ARG box for one or more of the operons that encode N-acetylglutamate kinase, N-acetylglutamylphosphate reductase, acetylornithine aminotransferase, N-acetylornithinase, ornithine transcarbamylase, argininosuccinate synthase, argininosuccinate lyase, carbamoylphosphate synthase, and wild-type N-acetylglutamate synthetase, such that ArgR binding is reduced or eliminated, thereby derepressing the regulon and enhancing arginine and/or intermediate byproduct biosynthesis. For example, the regulatory region of the operon encoding argininosuccinate synthase (argG) may be a constitutive, thereby driving arginine biosynthesis.

In some embodiments, all ARG boxes in one or more operons that comprise an arginine biosynthesis gene are mutated to reduce or eliminate ArgR binding. In some embodiments, all ARG boxes in one or more operons that encode an arginine biosynthesis enzyme are mutated to reduce or eliminate ArgR binding. In some embodiments, all ARG boxes in each operon that comprises an arginine biosynthesis gene are mutated to reduce or eliminate ArgR binding. In some embodiments, all ARG boxes in each operon that encodes an arginine biosynthesis enzyme are mutated to reduce or eliminate ArgR binding.

In some embodiments, the genetically engineered bacteria or genetically engineered viruses encode an arginine feedback resistant N-acetylglutamate synthase, argininosuccinate synthase driven by a constitutive promoter, and further comprise a mutant arginine regulon comprising one or more nucleic acid mutations in each ARG box for each of the operons that encode N-acetylglutamate kinase, N-acetylglutamylphosphate reductase, acetylornithine aminotransferase, N-acetylornithinase, ornithine transcarbamylase, argininosuccinate lyase, carbamoylphosphate synthase, and optionally, wild-type N-acetylglutamate synthetase, such that ArgR binding is reduced or eliminated, thereby derepressing the regulon and enhancing arginine biosynthesis.

In some embodiments, the genetically engineered bacteria or genetically engineered viruses comprise a mutant arginine regulon and a feedback resistant ArgA, and when the arginine feedback resistant ArgA is expressed, are capable of producing more arginine than unmodified bacteria of the same subtype under the same conditions.

In some embodiments, more than one ARG box may be present in a single operon. In one aspect of these embodiments, at least one of the ARG boxes in an operon is mutated to produce the requisite reduced ArgR binding to the regulatory region of the operon. In an alternate aspect of these embodiments, each of the ARG boxes in an operon is mutated to produce the requisite reduced ArgR binding to the regulatory region of the operon. For example, the carAB operon in *E. coli* Nissle comprises two ARG boxes, and one or both ARG box sequences may be mutated. The argG operon in *E. coli* Nissle comprises three ARG boxes, and one, two, or three ARG box sequences may be mutated, disrupted, or deleted. In some embodiments, all three ARG box sequences are mutated, disrupted, or deleted, and a constitutive promoter, e.g., BBa_J23100, is inserted in the regulatory region of the argG operon. One of skill in the art would appreciate that the number of ARG boxes per regulatory region may vary across bacteria, and the nucleotide sequences of the ARG boxes may vary for each operon.

"Arginine operon," "arginine biosynthesis operon," and "arg operon" are used interchangeably to refer to a cluster of one or more of the genes encoding arginine biosynthesis enzymes under the control of a shared regulatory region comprising at least one promoter and at least one ARG box. In some embodiments, the one or more genes are co-transcribed and/or co-translated. Any combination of the genes encoding the enzymes responsible for arginine biosynthesis may be organized, naturally or synthetically, into an operon. For example, in *B. subtilis*, the genes encoding N-acetylglutamylphosphate reductase, N-acetylglutamate kinase, N-acetylornithinase, N-acetylglutamate kinase, acetylornithine aminotransferase, carbamoylphosphate synthase, and ornithine transcarbamylase are organized in a single operon, argCAEBD-carAB-argF, under the control of a shared regulatory region comprising a promoter and ARG boxes. In *E. coli* K12 and Nissle, the genes encoding N-acetylornithinase, N-acetylglutamylphosphate reductase, N-acetylglutamate kinase, and argininosuccinate lyase are organized in two bipolar operons, argECBH. The operons encoding the enzymes responsible for arginine biosynthesis may be distributed at different loci across the chromosome. In unmodified bacteria, each operon may be repressed by arginine via ArgR. In some embodiments, arginine and/or intermediate byproduct production may be altered in the genetically engineered bacteria or genetically engineered viruses by modifying the expression of the enzymes encoded by the arginine biosynthesis operons as provided herein. Each arginine operon may be present on a plasmid or bacterial chromosome. In addition, multiple copies of any arginine operon, or a gene or regulatory region within an arginine operon, may be present in the bacterium or virus, wherein one or more copies of the operon or gene or regulatory region may be mutated or otherwise altered as described herein. In some embodiments, the genetically engineered bacteria or genetically engineered viruses are engineered to comprise multiple copies of the same product (e.g., operon or gene or regulatory region) to enhance copy number or to comprise multiple different components of an operon performing multiple different functions.

"ARG box consensus sequence" refers to an ARG box nucleic acid sequence, the nucleic acids of which are known to occur with high frequency in one or more of the regulatory regions of argR, argA, argB, argC, argD, argE, argF, argG, argH, argI, argJ, carA, and/or carB. As described above, each arg operon comprises a regulatory region comprising at least one 18-nucleotide imperfect palindromic sequence, called an ARG box, that overlaps with the promoter and to which the repressor protein binds (Tian et al., 1992). The nucleotide sequences of the ARG boxes may vary for each operon, and the consensus ARG box sequence is A/T nTGAAT A/T A/T T/A T/A ATTCAn T/A (Maas, 1994). The arginine repressor binds to one or more ARG boxes to actively inhibit the transcription of the arginine biosynthesis enzyme(s) that are operably linked to that one or more ARG boxes.

"Mutant arginine regulon" or "mutated arginine regulon" is used to refer to an arginine regulon comprising one or more nucleic acid mutations that reduce or eliminate arginine-mediated repression of each of the operons that encode the enzymes responsible for converting glutamate to arginine in the arginine biosynthesis pathway, such that the mutant arginine regulon produces more arginine and/or intermediate byproduct than an unmodified regulon from the same bacterial subtype under the same conditions. In some embodiments, the genetically engineered bacteria or genetically engineered viruses comprise an arginine feedback resistant N-acetylglutamate synthase mutant, e.g., argA$^{fbr}$, and a mutant arginine regulon comprising one or more nucleic acid mutations in at least one ARG box for one or more of the operons that encode the arginine biosynthesis enzymes N-acetylglutamate kinase, N-acetylglutamylphosphate reductase, acetylornithine aminotransferase, N-acetylornithinase, ornithine transcarbamylase, argininosuccinate synthase, argininosuccinate lyase, and carbamoylphosphate synthase, thereby derepressing the regulon and enhancing arginine and/or intermediate byproduct biosynthesis. In some embodiments, the genetically engineered bacteria or genetically engineered viruses comprise a mutant arginine repressor comprising one or more nucleic acid mutations such that arginine repressor function is decreased or inactive, or the genetically engineered bacteria or genetically engineered viruses do not have an arginine repressor (e.g., the arginine repressor gene has been deleted), resulting in derepression of the regulon and enhancement of arginine and/or intermediate byproduct biosynthesis. In some embodiments, the genetically engineered bacteria or genetically engineered viruses comprise an arginine feedback resistant N-acetylglutamate synthase mutant, e.g., argA$^{fbr}$, a mutant arginine regulon comprising one or more nucleic acid mutations in at least one ARG box for each of the operons that encode the arginine biosynthesis enzymes, and/or a mutant or deleted arginine repressor. In some embodiments, the genetically engineered bacteria or genetically engineered viruses comprise an arginine feedback resistant N-acetylglutamate synthase mutant, e.g., argA$^{fbr}$ and a mutant arginine regulon comprising one or more nucleic acid mutations in at least one ARG box for each of the operons that encode the arginine biosynthesis enzymes. In some embodiments, the genetically engineered bacteria or genetically engineered viruses comprise an arginine feedback resistant N-acetylglutamate synthase mutant, e.g., argA$^{fbr}$ and a mutant or deleted arginine repressor. In some embodiments, the mutant arginine regulon comprises an operon encoding wild-type N-acetylglutamate synthetase and one or more nucleic acid mutations in at least one ARG box for said operon. In some embodiments, the mutant arginine regulon comprises an operon encoding wild-type N-acetylglutamate synthetase and mutant or deleted arginine repressor. In some embodiments, the mutant arginine regulon comprises an operon encoding ornithine acetyltransferase (either in addition to or in lieu of N-acetylglutamate synthetase and/or N-acetylornithinase) and one or more nucleic acid mutations in at least one ARG box for said operon.

The ARG boxes overlap with the promoter in the regulatory region of each arginine biosynthesis operon. In the mutant arginine regulon, the regulatory region of one or more arginine biosynthesis operons is sufficiently mutated to disrupt the palindromic ARG box sequence and reduce ArgR binding, but still comprises sufficiently high homology to the promoter of the non-mutant regulatory region to be recognized as the native operon-specific promoter. The operon comprises at least one nucleic acid mutation in at least one ARG box such that ArgR binding to the ARG box and to the regulatory region of the operon is reduced or eliminated. In some embodiments, bases that are protected from DNA methylation and bases that are protected from hydroxyl radical attack during ArgR binding are the primary targets for mutations to disrupt ArgR binding. The promoter of the mutated regulatory region retains sufficiently high homology to the promoter of the non-mutant regulatory region such that RNA polymerase binds to it with sufficient affinity to promote transcription of the operably linked arginine biosynthesis enzyme(s). In some embodiments, the G/C:A/T ratio of the promoter of the mutant differs by no more than 10% from the G/C:A/T ratio of the wild-type promoter.

In some embodiments, more than one ARG box may be present in a single operon. In one aspect of these embodiments, at least one of the ARG boxes in an operon is altered to produce the requisite reduced ArgR binding to the regulatory region of the operon. In an alternate aspect of these embodiments, each of the ARG boxes in an operon is altered to produce the requisite reduced ArgR binding to the regulatory region of the operon.

"Reduced" ArgR binding is used to refer to a reduction in repressor binding to an ARG box in an operon or a reduction in the total repressor binding to the regulatory region of said operon, as compared to repressor binding to an unmodified ARG box and regulatory region in bacteria of the same subtype under the same conditions.

"ArgR" or "arginine repressor" is used to refer to a protein that is capable of suppressing arginine biosynthesis by regulating the transcription of arginine biosynthesis genes in the arginine regulon. When expression of the gene that encodes for the arginine repressor protein ("argR") is increased in a wild-type bacterium, arginine biosynthesis is decreased. When expression of argR is decreased in a wild-type bacterium or virus, or if argR is deleted or mutated to inactivate arginine repressor function, arginine biosynthesis is increased.

Bacteria that "lack any functional ArgR" and "ArgR deletion bacteria" are used to refer to bacteria in which each arginine repressor has significantly reduced or eliminated activity as compared to unmodified arginine repressor from bacteria of the same subtype under the same conditions. Reduced or eliminated arginine repressor activity can result in, for example, increased transcription of the arginine biosynthesis genes and/or increased concentrations of arginine. Bacteria in which arginine repressor activity is reduced or eliminated can be generated by modifying the bacterial argR gene or by modifying the transcription of the argR gene. For example, the chromosomal argR gene can be deleted, can be mutated, or the argR gene can be replaced with an argR gene that does not exhibit wild-type repressor activity.

In some embodiments, the genetically engineered bacteria or genetically engineered viruses comprising one or more nucleic acid mutations in at least one ARG box for one or more of the operons that encode the arginine biosynthesis enzymes N-acetylglutamate kinase, N-acetylglutamylphosphate reductase, acetylornithine aminotransferase, N-acetylornithinase, ornithine transcarbamylase, argininosuccinate synthase, argininosuccinate lyase, and carbamoylphosphate synthase additionally comprise an arginine feedback resistant N-acetylglutamate synthase mutant, e.g., argAfbr.

In some embodiments, the genetically engineered bacteria or genetically engineered viruses comprise a feedback resistant form of ArgA, as well as one or more nucleic acid mutations in each ARG box of one or more of the operons that encode the arginine biosynthesis enzymes N-acetylglutamate kinase, N-acetylglutamylphosphate reductase, acetylornithine aminotransferase, N-acetylornithinase, ornithine transcarbamylase, argininosuccinate synthase, argininosuccinate lyase, ornithine acetyltransferase, and carbamoylphosphate synthase.

In some embodiments, the genetically engineered bacteria or genetically engineered viruses comprise a feedback resistant form of ArgA, argininosuccinate synthase expressed from a constitutive promoter, as well as one or more nucleic acid mutations in each ARG box of each of the operons that encode the arginine biosynthesis enzymes N-acetylglutamate kinase, N-acetylglutamylphosphate reductase, acetylornithine aminotransferase, N-acetylornithinase, ornithine transcarbamylase, argininosuccinate synthase, argininosuccinate lyase, ornithine acetyltransferase, and carbamoylphosphate synthase. In these embodiments, the bacteria are capable of producing arginine.

The Table below shows examples of mutant constructs in which one or more nucleic acid mutations reduce or eliminate arginine-mediated repression of each of the arginine operons. The mutant constructs comprise feedback resistant form of ArgA driven by an oxygen level-dependent promoter, e.g., a FNR promoter. Each mutant arginine regulon comprises one or more nucleic acid mutations in at least one ARG box for one or more of the operons that encode N-acetylglutamate kinase, N-acetylglutamylphosphate reductase, acetylornithine aminotransferase, N-acetylornithinase, ornithine transcarbamylase, argininosuccinate synthase, argininosuccinate lyase, carbamoylphosphate synthase, and wild-type N-acetylglutamate synthetase, such that ArgR binding is reduced or eliminated, thereby enhancing arginine and/or intermediate byproduct biosynthesis. Non-limiting examples of mutant arginine regulon constructs are shown in Table 16 below.

TABLE 16

Examples of ARG Box Mutant Constructs

| Mutant construct comprises: | Exemplary Constructs (* indicates constitutive): | | | | | |
| --- | --- | --- | --- | --- | --- | --- |
| | Construct 1 | Construct 2 | Construct 3 | Construct 4 | Construct 5 | Construct 6 |
| Arginine feedback resistant N-acetylglutamate synthetase driven by an oxygen level-dependent promoter | ✓ | ✓ | ✓ | ✓ | ✓ | ✓ |

TABLE 16-continued

Examples of ARG Box Mutant Constructs

| Mutant construct comprises: | | Construct 1 | Construct 2 | Construct 3 | Construct 4 | Construct 5 | Construct 6 |
|---|---|---|---|---|---|---|---|
| Wild-type N-acetylglutamate synthetase | | ✓ | ✓ | | ✓ | ✓ | |
| Mutation(s) in at least one ARG box for the operon encoding: | Wild-type N-acetylglutamate synthetase | ✓ | | | ✓ | ✓ | ✓ |
| | N-acetylglutamate kinase | ✓ | ✓ | ✓ | ✓ | ✓ | ✓ |
| | N-acetylglutamylphosphate reductase | ✓ | ✓ | ✓ | ✓ | ✓ | ✓ |
| | acetylornithine aminotransferase | ✓ | ✓ | ✓ | ✓ | ✓ | ✓ |
| | N-acetylornithinase | ✓ | ✓ | ✓ | ✓ | ✓ | ✓ |
| | ornithine transcarbamylase | ✓ | ✓ | ✓ | ✓ | ✓ | ✓ |
| | argininosuccinate synthase | ✓ | ✓ | ✓ | ✓* | ✓* | ✓* |
| | argininosuccinate lyase | ✓ | ✓ | ✓ | ✓ | ✓ | ✓ |
| | ornithine acetyltransferase | ✓ | ✓ | ✓ | ✓ | ✓ | ✓ |
| | carbamoylphosphate synthase | ✓ | ✓ | ✓ | ✓ | ✓ | ✓ |

The mutations may be present on a plasmid or chromosome. In some embodiments, the arginine regulon is regulated by a single repressor protein. In particular species, strains, and/or subtypes of bacteria, it has been proposed that the arginine regulon may be regulated by two putative repressors (Nicoloff et al., 2004). Thus, in certain embodiments, the arginine regulon of the invention is regulated by more than one repressor protein.

In certain embodiments, the mutant arginine regulon is expressed in one species, strain, or subtype of genetically engineered bacteria. In alternate embodiments, the mutant arginine regulon is expressed in two or more species, strains, and/or subtypes of genetically engineered bacteria.

Arginine Repressor Binding Sites (ARG Boxes)

In some embodiments, the genetically engineered bacteria additionally comprise a mutant arginine regulon comprising one or more nucleic acid mutations in at least one ARG box for one or more of the operons that encode the arginine biosynthesis enzymes N-acetylglutamate kinase, N-acetylglutamylphosphate reductase, acetylornithine aminotransferase, N-acetylornithinase, ornithine transcarbamylase, argininosuccinate synthase, argininosuccinate lyase, and carbamoylphosphate synthase, such that the arginine regulon is derepressed and biosynthesis of arginine and/or an intermediate byproduct, e.g., citrulline, is enhanced.

In some embodiments, the mutant arginine regulon comprises an operon encoding ornithine acetyltransferase and one or more nucleic acid mutations in at least one ARG box for said operon. The one or more nucleic acid mutations results in the disruption of the palindromic ARG box sequence, such that ArgR binding to that ARG box and to the regulatory region of the operon is reduced or eliminated, as compared to ArgR binding to an unmodified ARG box and regulatory region in bacteria of the same subtype under the same conditions. In some embodiments, nucleic acids that are protected from DNA methylation and hydroxyl radical attack during ArgR binding are the primary targets for mutations to disrupt ArgR binding. In some embodiments, the mutant arginine regulon comprises at least three nucleic acid mutations in one or more ARG boxes for each of the operons that encode the arginine biosynthesis enzymes described above. The ARG box overlaps with the promoter, and in the mutant arginine regulon, the G/C:A/T ratio of the mutant promoter region differs by no more than 10% from the G/C:A/T ratio of the wild-type promoter region (Table 17). The promoter retains sufficiently high homology to the non-mutant promoter such that RNA polymerase binds with sufficient affinity to promote transcription.

The wild-type genomic sequences comprising ARG boxes and mutants thereof for each arginine biosynthesis operon in *E. coli* Nissle are shown in Table 17. For exemplary wild-type sequences, the ARG boxes are indicated in italics, and the start codon of each gene is boxed. The RNA polymerase binding sites are underlined (Cunin, 1983; Maas, 1994). In some embodiments, the underlined sequences are not altered. Bases that are protected from DNA methylation during ArgR binding are highlighted, and bases that are protected from hydroxyl radical attack during ArgR binding are bolded (Charlier et al., 1992). The highlighted and bolded bases are the primary targets for mutations to disrupt ArgR binding.

TABLE 17

Arg Box Sequences

| Regulatory region | Sequence |
|---|---|
| argA WT (SEQ ID NO: 85) | GCA<u>AAAAAAC</u>AGAA<u>TAAAAATACAATAA</u>TTTC<br><br>GAA<u>TAA</u>TCATGCAAAGAGGTGTACC GTG |

TABLE 17-continued

Arg Box Sequences

| Regulatory region | Sequence |
|---|---|
| argA mutant (SEQ ID NO: 86) | gcaaaaaaacactttaaaaacttaataatttcctttaatcacttaaagaggtgtaccgtg |
| argI WT (SEQ ID NO: 87) | AGAC<u>TTGCAAA</u>*T*GAA*TAA*TCATCCATA<u>TAG</u>*ATT* *GAATTT*<u>*TAA*</u>*TT*CATTAAGGCGTTAGCCACAGG AGGGATCT<span style="border:1px solid">ATG</span> |
| argI mutatnt (SEQ ID NO: 88) | agacttgcaaacttatacttatccatatagattttgttttaatttgttaaggcgttagccacaggagggatctatg |
| argCBH WT (SEQ ID NO: 89) | TCATT<u>GTTGACA</u>CACCTCTGGTCATGA<u>TAG</u>T *A<u>T</u>CAATATT<u>C</u>A*TGCAGTATTTTATGAATAAAAAT ACACTAACGTTGAGCGTAATAAAACCCACCA GCCGTAAGGTGAATGTTTTACGTTTAACCTG GCAACCAGACATAAGAAGGTGAATAGCCCC G<span style="border:1px solid">ATG</span> |
| argCBH mutant (SEQ ID NO: 90) | tcattgttgacacacctctggtcatgatagtatcaaacttcatgggatatttatctttaaaaatacttgaacgttgagcgtaataaaacccaccagccgtaaggtgaatgttttacgtttaacctggcaaccagacataagaaggtgaatagcccccgatg |
| argE WT (SEQ ID NO: 91) | CATCGGGGCTATTCACCTTCTTATGTCTGGTT GCCAGGTTAAACGTAAAACATTCACCTTACG GCTGGTGG<u>GTTTT</u>ATTACGCTCAACGTTAGT *G*<u>*T*</u>*ATTTTTATTCA*T*AAA***TACT*G*CATGAATA*TTGA* *TACTATCATGACCAGAGGTGTGTCAACA*<span style="border:1px solid">ATG</span> A |
| argE mutant (SEQ ID NO: 92) | catcggggctattcaccttcttatgtctggttgccaggttaaacgtaaaacattcaccttacggctggtgggttttattacgctcaacgttcaagtatttttaaagataaatatcccatgaagtttgatactatcatgaccagaggtgtgtcaacaatga |
| carAB WT (SEQ ID NO: 93) | AGCAGATTTGCA<u>TTGATT</u>TACGTCATCATTG *TGAATTAATATGCCAAAT<u>AA</u>AGTGAGTGAATATT CTCTGGAGGGTGTT*<span style="border:1px solid">TTG</span> |
| carAB mutant (SEQ ID NO: 94) | agcagatttgcattgatttacgtcatcattgtcttttaatatcttaataactggagtgacgtttctctggagggtgttttg |
| argD WT (SEQ ID NO: 95) | TTTCTGATTGCCATTC*AGT*GATTTTTTATGCAT ATTT*TGT*GATTATAATTTCATATTTATTTATGCG TAACAGGGTGATCATGAGATG |

TABLE 17-continued

Arg Box Sequences

| Regulatory region | Sequence |
|---|---|
| argD mutant (SEQ ID NO: 96) | tttctgattgccattcagtctttttttacttatattttgtctttataatcttatatttatt tatgcgtaacagggtgatcatgagatg |
| argG WT (SEQ ID NO: 97) | CTAATCA*CGTGAATGAATA TCCAGT*TCACTTT<br>CATTTGTTGAATACTTTTACCTTCTCCTGCTT<br>TCCCTTAAGCGCATTATTTTACAAAAAACAC<br>ACTAAACTCTTCCTGTCTCCGATAAAAGATG<br>*ATTAAATGAAAACTCATTTATTTTGCATAAAAAT*<br>*TCAGT*GAAAGCAGAAATCCAGGCTCATCATC<br>AGTTAATTAAGCAGGGTGTTATTTT ATG |
| argG mutant (SEQ ID NO: 98) | ctaatcaccttaatgaatcttcagttcactttcatttgttgaatacttttaccttct cctgctttcccttaagcgcattattttacaaaaaacacactaaactcttcctgt ctccgataaaagatgatcttatgaaaaccttttttatttcttataaaaatcttgtg aaagcagaaatccaggctcatcatcagttaattaagcagggtgttattttat g |
| argG mutant (SEQ ID NO: 99) | cctgaaacgtggcaaattctactcgttttgggtaaaaaatgcaaatactgct gggatttggtgtaccgagacgggacgtaaaatctgcaggcattatagtga tccacgccacattttgtcaacgtttattgctaatcattgacggctagctcagt cctaggtacagtgctagcACCCGTTTTTTTGGGCTAGA AATAATTTTGTTTAACTTTAAGAAGGAGATA TACATACCC |

In some embodiments, the ARG box is at least about 80%, at least about 85%, at least about 90%, at least about 95%, or at least about 99% homologous to the sequence of SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, and/or SEQ ID NO: 99.

In some embodiments, more than one ARG box may be present in a single operon. In one aspect of these embodiments, at least one of the ARG boxes in an operon is mutated to produce the requisite reduced ArgR binding to the regulatory region of the operon. In an alternate aspect of these embodiments, each of the ARG boxes in an operon is mutated to produce the requisite reduced ArgR binding to the regulatory region of the operon. One of skill in the art would appreciate that the number of ARG boxes per regulatory region may vary across bacteria, and the nucleotide sequences of the ARG boxes may vary for each operon. For example, the carAB operon in *E. coli* Nissle comprises two ARG boxes, and one or both ARG box sequences may be mutated. The argG operon in *E. coli* Nissle comprises three ARG boxes, and one, two, or three ARG box sequences may be mutated, disrupted, or deleted. In some embodiments, all three ARG box sequences are mutated, disrupted, or deleted, and a constitutive promoter, e.g., BBa_J23100, is inserted in the regulatory region of the argG operon. One of skill in the art would appreciate that the number of ARG boxes per regulatory region may vary across bacteria, and the nucleotide sequences of the ARG boxes may vary for each operon.

An exemplary embodiment of a constitutively expressed argG construct in *E. coli* Nissle is depicted in Table 18. Table 18 depicts the wild-type genomic sequence of the regulatory region and 5' portion of the argG gene in *E. coli* Nissle, and a constitutive mutant thereof. The promoter region of each sequence is underlined, and a 5' portion of the argG gene is boxed . In the wild-type sequence, ArgR binding sites are in uppercase and underlined. In the mutant sequence, the 5' untranslated region is in uppercase and underlined. Bacteria expressing argG under the control of the constitutive promoter are capable of producing arginine. Bacteria expressing argG under the control of the wild-type, ArgR-repressible promoter are capable of producing citrulline. A map of the wild-type argG operon *E. coli* Nissle and a constitutively expressing mutant thereof is shown in FIG. 19.

TABLE 18

ArgG construct

| Description | Sequence |
|---|---|
| Wild-type argG (SEQ ID NO: 100) | gtgatccacgccacattttgtcaacgtttattgctaataCGTGAATGAATATCCAGTtcactttcat ttgttgaatacttttaccttctcctgctttcccttaagcgcattattttacaaaaaacacactaaactcttcctgtctccga taaaagatgATTAAATGAAAACTCATTtatTTTGCATAAAAATTCAGTgaaag cagaaatccaggctcatcatcagttaattaagcagggtgttattttatgacgacgattctcaagcatctcccggtag gtcaacgtattggtatcgcttttccggcggtctggacaccagtgccgcactgctgtggatgcgacaaaagggag cggttccttatgcatatactgcaaacctgggccagccagacgaagaggattatgatgcgatccctcgtcgtgcca tggaatacggcgcggagaacgcacgtctgatcgactgccgcaaacaactggtggccgaaggtattgccgtat tcagtgtggcgcatttcataacaccactggtggactgacctatttcaacacgacgccgctgggccgcgccgtga ccggcaccatgctggttgctgctatgaaagaagatggcgtgaatatctggggtgacggcagcacctataaagga aacgatatcgaacgtttctaccgttacggtctgctgaccaatgctgaactgcagatttacaaaccgtggcttgatac tgactttattgatgaactgggtggccgtcatgagatgtctgaatttatgattgcctgcggtttcgactacaaaatgtct gtcgaaaaagcttactccacggactccaacatgcttggtgcaacgcatgaagcgaaggatctggaatacctcaa ctccagcgtcaaaatcgtcaacccaattatgggcgtgaagttttgggatgagagcgtgaaaatcccggcagaag aagtcacagtcagctttgagcaaggtcatccggtggcgctgaacggtaaaacctttagcgacgacgtagaaatg atgctggaagctaaccgcatcggc |
| Constitutive argG (SEQ ID NO: 101) | ttgacggctagctcagtcctaggtacagtgctagcACCCGTTTTTTTGGGCTAGAAATAA TTTTGTTTAACTTTAAGAAGGAGATATACATACCCatgacgacgattctcaagc atctcccggtaggtcaacgtattggtatcgcttttccggcggtctggacaccagtgccgcactgctgtggatgcg acaaaagggagcggttccttatgcatatactgcaaacctgggccagccagacgaagaggattatgatgcgatcc ctcgtcgtgccatggaatacggcgcggagaacgcacgtctgatcgactgccgcaaacaacctggtggccgaag gtattgccgctattcagtgtggcgcatttcataacaccactggtggactgacctatttcaacacgacgccgctggg ccgcgccgtgaccggcaccatgctggttgctgctatgaaagaagatggcgtgaatatctggggtgacggcagc acctataaaggaaacgatatcgaacgtttctaccgttacggtctgctgaccaatgctgaactgcagatttacaaac cgtggcttgatactgactttattgatgaactgggtggccgtcatgagatgtctgaatttatgattgcctgcggtttcga ctacaaaatgtctgtcgaaaaagcttactccacggactccaacatgcttggtgcaacgcatgaagcgaaggatct ggaatacctcaactccagc |

In some embodiments, the ARG construct is at least about 80%, at least about 85%, at least about 90%, at least about 95%, or at least about 99% homologous to the sequence of SEQ ID NO: 100 and/or SEQ ID NO: 101.

Arginine Repressor (ArgR)

The genetically engineered bacteria or genetically engineered viruses comprise an arginine regulation comprising one or more nucleic acid mutations that reduce or eliminate arginine-mediated repression of one or more of the operons that encode the enzymes responsible for converting glutamate to arginine and/or an intermediate byproduct in the arginine biosynthesis pathway. In some embodiments, the reduction or elimination of arginine-mediated repression may be achieved by reducing or eliminating ArgR repressor binding, e.g., by mutating at least one ARG box for one or more of the operons that encode the arginine biosynthesis enzymes (as discussed above) or by mutating or deleting the arginine repressor (discussed here) and/or by reducing or eliminating arginine binding to N-acetylglutamate synthetase (e.g., by mutating the N-acetylglutamate synthetase to produce an arginine feedback resistant N-acetylglutamate synthase mutant, e.g., argA$^{fbr}$).

Thus, in some embodiments, the genetically engineered bacteria 1 or genetically engineered viruses ack a functional ArgR repressor and therefore ArgR repressor-mediated transcriptional repression of each of the arginine biosynthesis operons is reduced or eliminated. In some embodiments, the engineered bacteria comprise a mutant arginine repressor comprising one or more nucleic acid mutations such that arginine repressor function is decreased or inactive. In some embodiments, the genetically engineered bacteria or genetically engineered viruses do not have an arginine repressor (e.g., the arginine repressor gene has been deleted), resulting in depression of the regulon and enhancement of arginine and/or intermediate byproduct biosynthesis. In some embodiments, each copy of a functional argR gene normally present in a corresponding wild-type bacterium is independently deleted or rendered inactive by one or more nucleotide deletions, insertions, or substitutions. In some embodiments, each copy of the functional argR gene normally present in a corresponding wild-type bacterium is deleted.

In some embodiments, the arginine regulon is regulated by a single repressor protein. In particular species, strains, and/or subtypes of bacteria, it has been proposed that the arginine regulon may be regulated by two distinct putative repressors (Nicoloff et al., 2004). Thus, in certain embodiments, two distinct ArgR proteins each comprising a different amino acid sequence are mutated or deleted in the genetically engineered bacteria or genetically engineered viruses.

In some embodiments, the genetically modified bacteria or genetically engineered viruses comprising a mutant or deleted arginine repressor additionally comprise an arginine feedback resistant N-acetylglutamate synthase mutant, e.g., $argA^{fbr}$. In some embodiments, the genetically engineered bacteria or genetically engineered viruses comprise a feedback resistant form of ArgA, lack any functional arginine repressor, and are capable of producing arginine. In some embodiments, the argR gene is deleted in the genetically engineered bacteria or genetically engineered viruses. In some embodiments, the argR gene is mutated to inactivate ArgR function. In some embodiments, the argG gene is deleted in the genetically engineered bacteria or genetically engineered viruses. In some embodiments, the argG gene is mutated to inactivate ArgR function. In some embodiments, the genetically engineered bacteria or genetically engineered viruses comprise $argA^{fbr}$ and deleted ArgR. In some embodiments, the genetically engineered bacteria or genetically engineered viruses comprise $argA^{fbr}$, deleted ArgR, and deleted argG. In some embodiments, the deleted ArgR and/or the deleted argG is deleted from the bacterial genome and the $argA^{fbr}$ is present in a plasmid. In some embodiments, the deleted ArgR and/or the deleted argG is deleted from the bacterial genome and the $argA^{fbr}$ is chromosomally integrated. In one specific embodiment, the genetically modified bacteria or genetically engineered viruses comprise chromosomally integrated $argA^{fbr}$, deleted genomic ArgR, and deleted genomic argG. In another specific embodiment, the genetically modified bacteria comprise $argA^{fbr}$ present on a plasmid, deleted genomic ArgR, and deleted genomic argG.

Feedback Resistant N-Acetylglutamate Synthetase

In some embodiments, the genetically engineered bacteria or genetically engineered viruses comprise an arginine feedback resistant N-acetylglutamate synthase mutant, e.g., $argA^{fbr}$. In some embodiments, the genetically engineered bacteria or genetically engineered viruses comprise a mutant arginine regulon comprising an arginine feedback resistant ArgA, and when the arginine feedback resistant ArgA is expressed, are capable of producing more arginine and/or an intermediate byproduct than unmodified bacteria of the same subtype under the same conditions. The arginine feedback resistant N-acetylglutamate synthetase protein ($argA^{fbr}$) is significantly less sensitive to L-arginine than the enzyme from the feedback sensitive parent strain (see, e.g., Eckhardt et al., 1975; Rajagopal et al., 1998). The feedback resistant argA gene can be present on a plasmid or chromosome. In some embodiments, expression from the plasmid may be useful for increasing $argA^{fbr}$ expression. In some embodiments, expression from the chromosome may be useful for increasing stability of $argA^{fbr}$ expression.

In some embodiments, any of the genetically engineered bacteria or genetically engineered viruses of the present disclosure are integrated into the bacterial chromosome at one or more integration sites. For example, one or more copies of the sequence encoding the arginine feedback resistant N-acetylglutamate synthase may be integrated into the bacterial chromosome. Having multiple copies of the arginine feedback resistant N-acetylglutamate synthase integrated into the chromosome allows for greater production of the N-acetylglutamate synthase and also permits fine-tuning of the level of expression. Alternatively, different circuits described herein, such as any of the kill-switch circuits, in addition to the arginine feedback resistant N-acetylglutamate synthase could be integrated into the bacterial chromosome at one or more different integration sites to perform multiple different functions.

Multiple distinct feedback resistant N-acetylglutamate synthetase proteins are known in the art and may be combined in the genetically engineered bacteria or genetically engineered viruses. In some embodiments, the $argA^{fbr}$ gene is expressed under the control of a constitutive promoter. In some embodiments, the $argA^{fbr}$ gene is expressed under the control of a promoter that is induced by tumor microenvironment.

In some embodiments, the plasmid or chromosome also comprises wild-type ArgR binding sites, e.g., ARG boxes. In some instances, the presence and/or build-up of functional ArgR may result in off-target binding at sites other than the ARG boxes, which may cause off-target changes in gene expression. A plasmid or chromosome that further comprises functional ARG boxes may be used to reduce or eliminate off-target ArgR binding, i.e., by acting as an ArgR sink. In some embodiments, the plasmid or chromosome does not comprise functional ArgR binding sites, e.g., the plasmid or chromosome comprises modified ARG boxes or does not comprise ARG boxes.

In some embodiments, the genetically engineered bacteria or genetically engineered viruses comprise $argA^{fbr}$ expressed under the control of an oxygen level-dependent promoter, e.g., a FNR promoter, as well as wild-type argA expressed under the control of a mutant regulatory region comprising one or more ARG box mutations as discussed above. In certain embodiments, the genetically engineered bacteria or genetically engineered viruses comprise $argA^{fbr}$ expressed under the control of an oxygen level-dependent promoter, e.g., a FNR promoter and do not comprise wild-type argA. In still other embodiments, the mutant arginine regulon comprises $argA^{fbr}$ expressed under the control of an oxygen level-dependent promoter, e.g., a FNR promoter, and further comprises wild-type argA without any ARG box mutations.

In some embodiments, the genetically engineered bacteria or genetically engineered viruses express $ArgA^{fbr}$ from a plasmid and/or chromosome. In some embodiments, the $argA^{fbr}$ gene is expressed under the control of a constitutive promoter. In some embodiments, the $argA^{fbr}$ gene is expressed under the control of an inducible promoter. In one embodiment, $argA^{fbr}$ is expressed under the control of an oxygen level-dependent promoter that is activated under low-oxygen or anaerobic environments, e.g., a FNR promoter.

In any of the above described embodiments relating to the production of arginine, an oncolytic virus may be engineered in the same manner as described for an engineered bacteria.

The nucleic acid sequence of an exemplary $argA^{fbr}$ sequence is shown in Table 19. The polypeptide sequence of an exemplary $argA^{fbr}$ sequence is shown in Table 20.

TABLE 19

Nucleotide sequence of argA^fbr
Nucleotide sequence of exemplary argA^fbr sequence
(SEQ ID NO: 102)

ATGGTAAAGGAACGTAAAACCGAGTTGGTCGAGGGATTCCGCCATTCGGT

TCCCTGTATCAATACCCACCGGGGAAAAACGTTTGTCATCATGCTCGGCG

GTGAAGCCATTGAGCATGAGAATTTCTCCAGTATCGTTAATGATATCGGG

TTGTTGCACAGCCTCGGCATCCGTCTGGTGGTGGTCTATGGCGCACGTCC

GCAGATCGACGCAAATCTGGCTGCGCATCACCACGAACCGCTGTATCACA

AGAATATACGTGTGACCGACGCCAAAACACTGGAACTGGTGAAGCAGGCT

GCGGGAACATTGCAACTGGATATTACTGCTCGCCTGTCGATGAGTCTCAA

TAACACGCCGCTGCAGGGCGCGCATATCAACGTCGTCAGTGGCAATTTTA

TTATTGCCCAGCCGCTGGGCGTCGATGACGGCGTGGATTACTGCCATAGC

GGGCGTATCCGGCGGATTGATGAAGACGCGATCCATCGTCAACTGGACAG

CGGTGCAATAGTGCTAATGGGGCCGGTCGCTGTTTCAGTCACTGGCGAGA

GCTTTAACCTGACCTCGGAAGAGATTGCCACTCAACTGGCCATCAAACTG

AAAGCTGAAAAGATGATTGGTTTTTGCTCTTCCCAGGGCGTCACTAATGA

CGACGGTGATATTGTCTCCGAACTTTTCCCTAACGAAGCGCAAGCGCGGG

TAGAAGCCCAGGAAGAGAAAGGCGATTACAACTCCGGTACGGTGCGCTTT

TTGCGTGGCGCAGTGAAAGCCTGCCGCAGCGGCGTGCGTCGCTGTCATTT

AATCAGTTATCAGGAAGATGGCGCGCTGTTGCAAGAGTTGTTCTCACGCG

ACGGTATCGGTACGCAGATTGTGATGGAAAGCGCCGAGCAGATTCGTCGC

GCAACAATCAACGATATTGGCGGTATTCTGGAGTTGATTCGCCCACTGGA

GCAGCAAGGTATTCTGGTACGCCGTTCTCGCGAGCAGCTGGAGATGGAAA

TCGACAAATTCACCATTATTCAGCGCGATAACACGACTATTGCCTGCGCC

GCGCTCTATCCGTTCCCGGAAGAGAAGATTGGGGAAATGGCCTGTGTGGC

AGTTCACCCGGATTACCGCAGTTCATCAAGGGGTGAAGTTCTGCTGGAAC

GCATTGCCGCTCAGGCTAAGCAGAGCGGCTTAAGCAAATTGTTTGTGCTG

ACCACGCGCAGTATTCACTGGTTCCAGGAACGTGGATTTACCCCAGTGGA

TATTGATTTACTGCCCGAGAGCAAAAAGCAGTTGTACAACTACCAGCGTA

AATCCAAAGTGTTGATGGCGGATTTAGGGTAA

TABLE 20 argAfbr polypeptide sequence
Polypeptide sequence of exemplary argA^fbr sequence
(SEQ ID NO: 103)

MVKERKTELVEGFRHSVPCINTHRGKTFVIMLGGEAIEHENFSSIVNDI

GLLHSLGIRLVVVYGARPQIDANLAAHHHEPLYHKNIRVTDAKTLELVK

QAAGTLQLDITARLSMSLNNTPLQGAHINVVSGNFIIAQPLGVDDGVDY

TABLE 20-continued argAfbr polypeptide sequence
Polypeptide sequence of exemplary argA^fbr sequence
(SEQ ID NO: 103)

CHSGRIRRIDEDAIHRQLDSGAIVLMGPVAVSVTGESFNLTSEEIATQL

AIKLKAEKMIGFCSSQGVTNDDGDIVSELFPNEAQARVEAQEEKGDYNS

GTVRFLRGAVKACRSGVRRCHLISYQEDGALLQELFSRDGIGTQIVMES

AEQIRRATINDIGGILELIRPLEQQGILVRRSREQLEMEIDKFTIIQRD

NTTIACAALYPFPEEKIGEMACVAVHPDYRSSSRGEVLLERIAAQAKQS

GLSKLFVLTTRSIHWFQERGFTPVDIDLLPESKKQLYNYQRKSKVL

MADLG

Bold underline: mutated amino acid resulting feedback resistance. (mutation is Y19C)

In some embodiments, the genetically engineered bacteria comprise the nucleic acid sequence of SEQ ID NO: 102 or a functional fragment thereof. In some embodiments, the genetically engineered bacteria comprise a nucleic acid sequence that, but for the redundancy of the genetic code, encodes the same polypeptide as SEQ ID NO: 102 or a functional fragment thereof. In some embodiments, genetically engineered bacteria comprise a nucleic acid sequence that is at least about 80%, at least about 85%, at least about 90%, at least about 95%, or at least about 99% homologous to the DNA sequence of SEQ ID NO: 102 or a functional fragment thereof, or a nucleic acid sequence that, but for the redundancy of the genetic code, encodes the same polypeptide as SEQ ID NO: 102 or a functional fragment thereof.

In some embodiments, the genetically engineered bacteria encode a polypeptide sequence of SEQ ID NO: 103 or a functional fragment thereof. In some embodiments, the genetically engineered bacteria encode a polypeptide sequence encodes a polypeptide, which contains one or more conservative amino acid substations relative to SEQ ID NO: 103 or a functional fragment thereof. In some embodiments, genetically engineered bacteria encode a polypeptide sequence that is at least about 80%, at least about 85%, at least about 90%, at least about 95%, or at least about 99% homologous to the DNA sequence of SEQ ID NO: 103 or a functional fragment thereof.

In some embodiments, arginine feedback inhibition of N-acetylglutamate synthetase is reduced by at least about 50%, at least about 60%, at least about 70%, at least about 80%, at least about 90%, or at least about 95% in the genetically engineered bacteria when the arginine feedback resistant N-acetylglutamate synthetase is active, as compared to a wild-type N-acetylglutamate synthetase from bacteria of the same subtype under the same conditions.

Table 21. Lists Exemplary Arginine Production Strains. Arginine producing strains are also described in Incorporate PCT/US2016/034200, filed May 25, 2016 and Ser. No. 15/164,828 filed May 25, 2016, published as US20160333326, and PCT/US2015/064140, filed Dec. 4, 2015, and U.S. Pat. No. 9,487,764, filed Dec. 4, 2015, the contents of each of which is herein incorporated by reference it its entirety.

TABLE 21

Exemplary Arginine Production Strains

| Code Name | ARG box | ArgR | argA$^{fb}$ | ThyA | Antibiotic | Other |
|---|---|---|---|---|---|---|
| ΔARG box | | | | | | |
| SYN-UCD101 | ΔARG box | Wild type ArgR | none | Wild type ThyA | none | none |
| SYN-UCD102 | ΔARG box | Wild type ArgR | tetracycline-inducible argA$^{fbr}$ on a low copy plasmid | Wild type ThyA | Amp | none |
| SYN-UCD104 | ΔARG box | Wild type ArgR | tetracycline-inducible argA$^{fbr}$ on a low copy plasmid (Amp) | Wild type ThyA | Amp, Cam | Inducible ArgG |
| SYN-UCD105 | ΔARG box | Wild type ArgR | tetracycline-inducible argA$^{fbr}$ on a low copy plasmid (Amp) | Wild type ThyA | Amp | constitutively expressed argG (BBa_J23100 constitutive promoter) |
| ΔArgR | | | | | | |
| SYN-UCD106 | Wild type ARG Box | ΔArgR | none | ΔThyA | Cam | none |
| SYN-UCD201/SYN-UCD312 | Wild type ARG Box | ΔArgR | none | Wild type ThyA | none | none |
| SYN-UCD202 | Wild type ARG Box | ΔArgR | tetracycline-inducible argAfbr on a high-copy plasmid (Amp) | Wild type ThyA | Amp | none |
| SYN-UCD203 | Wild type ARG Box | ΔArgR | tetracycline-inducible argAfbr on a low-copy plasmid (Amp) | Wild type ThyA | Amp | none |
| SYN-UCD204 | Wild type ARG Box | ΔArgR | tet-ArgAfbr on a low-copy plasmid (Amp) | Wild type ThyA | Amp | none |
| SYN-UCD205 | Wild type ARG Box | ΔArgR | PfnrS-ArgAfbr on a low-copy plasmid (Amp) | Wild type ThyA | Amp | none |
| SYN-UCD206 | Wild type ARG Box | ΔArgR | PfnrS-ArgAfbr on a low-copy plasmid (Amp) | ΔThyA | Amp, Cam | none |
| Integrated FNRS-argAfbr | | | | | | |
| SYN-UCD301 | Wild type ARG Box | ΔArgR | PfnrS-ArgAfbr integrated into the chromosome at the malEK locus | Wild type ThyA | Cam | none |
| SYN-UCD302 | Wild type ARG Box | ΔArgR | PfnrS-ArgAfbr integrated into the chromosome at the malEK locus | ΔThyA | Cam | none |
| SYN-UCD303 | Wild type ARG Box | ΔArgR | PfnrS-ArgAfbr integrated | ΔThyA | Kan | none |

TABLE 21-continued

Exemplary Arginine Production Strains

| Code Name | ARG box | ArgR | argA^fb | ThyA | Antibiotic | Other |
|---|---|---|---|---|---|---|
| SYN-UCD305 | Wild type ARG Box | ΔArgR | into the chromosome at the malEK locus PfnrS-ArgAfbr integrated into the chromosome at the malEK locus | ΔThyA | None | none |
| SYN-UCD304 | Wild type ARG Box | ΔArgR | PfnrS-ArgAfbr integrated into the chromosome at the malEK locus | Wild type ThyA | None | none |
| SYN-UCD306 | Wild type ARG Box | ΔArgR | PfnrS-ArgAfbr integrated into the chromosome at the malEK locus | Wild type ThyA | Kan | none |
| SYN-UCD307 | Wild type ARG Box | Wild type ArgR | PfnrS-ArgAfbr integrated into the chromosome at the malEK locus | ΔThyA | Kan | none |
| SYN-UCD308 | Wild type ARG Box | Wild type ArgR | PfnrS-ArgAfbr integrated into the chromosome at the malEK locus | ΔThyA | none | none |
| SYN-UCD309 | Wild type ARG Box | Wild type ArgR | PfnrS-ArgAfbr integrated into the chromosome at the malEK locus | Wild type ThyA | Kan | none |
| SYN-UCD310 | Wild type ARG Box | Wild type ArgR | PfnrS-ArgAfbr integrated into the chromosome at the malEK locus | Wild type ThyA | none | none |
| SYN-UCD311 | Wild type ARG Box | ΔArgR | none | Wild type ThyA | Kan | none |
| SYN-UCD312/ SYN-UCD201 | Wild type ARG Box | ΔArgR | none | Wild type ThyA | none | none |
| SYN-UCD313 | Wild type ARG Box | ΔArgR | none | ΔThyA | Kan | none |
| SYN-UCD314 | Wild type ARG Box | ΔArgR | none | ΔThyA | none | none |

In some embodiments, the genetically engineered microorganisms for the production of arginine are capable of expressing any one or more of the described circuits in low-oxygen conditions, and/or in the presence of cancer and/or the tumor microenvironment, or tissue specific molecules or metabolites, and/or in the presence of molecules or metabolites associated with inflammation or immune suppression, and/or in the presence of metabolites that may be present in the gut, and/or in the presence of metabolites that may or may not be present in vivo, and may be present in vitro during strain culture, expansion, production and/or manufacture, such as arabinose and others described herein. In some embodiments, the gene sequences(s) for the production of arginine are controlled by a promoter inducible by such conditions and/or inducers. In some embodiments, the gene sequences(s) are controlled by a constitutive promoter, as described herein. In some embodiments, the gene sequences(s) are controlled by a constitutive promoter, and are expressed in in vivo conditions and/or in vitro conditions, e.g., during expansion, production and/or manufacture, as described herein.

In some embodiments, any one or more of the described circuits for the production of arginine are present on one or more plasmids (e.g., high copy or low copy) or are integrated into one or more sites in the microorganisms' chromosome. Also, in some embodiments, the genetically engineered microorganisms are further capable of expressing any one or more of the described circuits and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, (6) one or more surface display circuits, such as any of the surface display circuits described herein and otherwise known in the art and (7) one or more circuits for the production or degradation of one or more metabolites (e.g., kynurenine, tryptophan, adenosine, arginine) described herein (8) combinations of one or more of such additional circuits.

In a non-limiting example, the arginine production circuit may be combined with an anit-CD47 secretion circuit.

Inhibition or Depletion of PGE2

Prostaglandin E2 (PGE2) is overproduced in many tumors, where it aids in cancer progression. PGE2 is a pleiotropic molecule involved in numerous biological processes, including angiogenesis, apoptosis, inflammation, and immune suppression. PGE2 is synthesized from arachidonic acid by cyclooxygenase 2 (COX-2). COX-2, converts arachidonic acid (AA) to prostaglandin endoperoxide H2 (PGH2). PHG2 is then converted to PHE2 by prostaglandin E synthase (PGES), of which there are three forms. PGE2 can be catabolized into biologically inactive 15-keto-PGs by 15-PGDH and carbonyl reductase or secreted by the secreter MRP4.

MDSCs are thought to play a key role in the PGE2 production in the tumor environment. Tumor derived factors induce COX2, PGES1, and MRP4 and downregulate the expression of 15-PGDH in MDSCs, and is associated with MDSC suppressive activity. Inhibition of PGE2 through COX-2 inhibitors show promise as cancer treatments, but systemic administration is associated with serious side effects, and in the case of the COX-2 inhibitor celecoxib, resistance to tumor prevention has been observed.

In addition to inhibition of PGE production, the degradation of PGE2 by 15-hydroxyprostaglandin dehydrogenase (15-PGDH) is another way to reduce PGE2 levels in tumors. A lack of prostaglandin dehydrogenase prevents catabolism of prostaglandin E2, which helps cancer cells both to evade the immune system and circumvent drug treatment. Recent studies have demonstrated that 15-PGDH delivered locally to the tumor microenvironment can effect an antitumor immune response. For example, injection of an adenovirus encoding 15-PGDH into mouse tumors comprising non-lymphocyte white blood cells expressing CD11b (which have increased PGE2 levels, higher COX-2 expression and significantly reduced expression of 15-PGDH as compared with cells from outside the tumor), resulted in significantly slowed tumor growth. These studies further showed that 15-PGDH expression was highest in tumor cells but also significant in tumor-associated CD11b cells, where it produced a four-fold reduction in PGE2 secretion. This was associated with reduced secretion of immunosuppressive cytokines by the CD11b cells which resulted in a switch in their fate, promoting their differentiation into dendritic cells. These studies show that overproduction of PGE2 in tumors contributes to immune evasion by preventing maturation of antigen-presenting cells, and that evasion can be overcome by enforced expression of 15-PGDH. (Eruslanov et al., Volume 88, November 2010 Journal of Leukocyte Biology; Tumor-mediated induction of myeloid-derived suppressor cells and M2-polarized macrophages by altering intracellular PGE2 catabolism in myeloid cells).

Other studies confirm the benefit of local PGE2 catabolism in cancer treatment. Celecoxib, a non-steroidal anti-inflammatory COX-2 inhibitor used to treat pain and inflammation, reduces the recurrence of colon adenomas but does not work in some patients who have low levels of 15-PGDH. These results correspond with studies which show that in mice, gene knockout of 15-PGDH confers near-complete resistance to the ability of celecoxib to prevent colon tumors. These and other studies highlight the potential importance of reducing PGE2 levels in cancer, either through inhibition of synthesis or promotion of catalysis or both.

In some embodiments, the genetically engineered microorganisms, e.g. genetically engineered bacteria or genetically engineered oncolytic viruses produce one or more anti-cancer molecules that are able to decrease or deplete the level of PGE2 in the tumor microenvironment. In certain embodiments, the genetically engineered bacteria or genetically engineered oncolytic viruses produce one or more anti-cancer molecules that are able to inhibit or decrease PGE2 production, e.g., produce a COX-2 inhibitor or an inhibitor of an enzyme in the arachidonic acid synthesis pathway. In certain embodiments, the genetically engineered bacteria or genetically engineered oncolytic viruses produce one or more anti-cancer molecules that promote PGE2 uptake from the tumor microenvironment, e.g., express a PGE2 transporter. In certain embodiments, the genetically engineered bacteria or genetically engineered oncolytic viruses produce one or more anti-cancer molecules that promote, enhance or stimulate PGE2 degradation. In certain embodiments, the genetically engineered bacteria or genetically engineered oncolytic viruses produce one or more anti-cancer molecules that degrade PGE2. In some embodiments, the genetically engineered bacteria or genetically engineered oncolytic viruses produce 15-hydroxyprostaglandin dehydrogenase. In some embodiments, the genetically engineered bacteria or genetically engineered oncolytic viruses produce one or more anti-cancer molecules that are able to inhibit or decrease PGE2 production, and/or promote PGE2 uptake from the tumor microenvironment, e.g., express a PGE2 transporter and/or promote PGE2 degradation, e.g., produce 15-hydroxyprostaglandin dehydrogenase. In any of these embodiments, the genetically engineered bacterium or genetically engineered oncolytic virus is a tumor-targeting bacterium or tumor-targeting oncolytic virus. In some embodiments, the genetically engineered bacterium or genetically engineered oncolytic virus comprises sequence for encoding a PGE2 transporter and/or comprise sequence for encoding 15-hydroxyprostaglandin dehydrogenase, under the control of a promoter that is activated by low-oxygen conditions. In some embodiments, the genetically engineered bacterium or genetically engineered oncolytic virus comprises sequence for encoding a PGE2 transporter and/or comprise sequence for encoding 15-hydroxyprostaglandin dehydrogenase under the control of a promoter that is activated by hypoxic conditions, or by inflammatory conditions, such as any of the promoters activated by said conditions and described herein. In some embodiments, the genetically engineered bacteria or genetically engineered OV comprises sequence for encoding a PGE2 transporter and/or comprise sequence for encoding 15-hydroxyprostaglandin dehydrogenase under the control of a cancer-specific promoter, a tissue-specific promoter, or a constitutive promoter, such as any of the promoters described herein.

Immunosuppressive Cytokines

Certain cytokines, known as immunosuppressive cytokines, are secreted from tumor cells and function to suppress innate and/or adaptive immune responses, in some cases through Tregs, TAMs, and DCregs. Thus, in certain embodiments, the genetically engineered bacteria or genetically engineered oncolytic viruses produce one or more anti-cancer molecules that inhibit one or more immunosuppressive cytokines. Interleukin-10 (IL-10), also known as human cytokine synthesis inhibitory factor (CSIF), is an anti-inflammatory cytokine that is produced by monocytes and lymphocytes (e.g., type 2 T helper cells, mastocytes, $CD4^+$ $CD25^+Foxp3^+$regulatory T cells (Tregs). IL-10 can be produced by monocytes upon PD-1 triggering in these cells. Il-10 has been shown to downregulate the expression of Th1 cytokines, MHC class II antigens, and co-stimulatory molecules on macrophages. It has also been reported to suppress cytokine secretion, antigen presentation and CD4+ T cell activation. Further investigation has shown that IL-10 inhibits lipopolysaccharide (LPS) and bacterial product mediated induction of the pro-inflammatory cytokines TNFα, IL-1β, IL-12, and IFNγ secretion from Toll-Like Receptor (TLR) triggered myeloid lineage cells.

In certain embodiments, the genetically engineered bacteria or genetically engineered oncolytic viruses produce an anti-cancer molecule that indirectly or directly inhibits IL-10, for example, the genetically engineered microorganism may encode an antibody directed against IL-10, e.g. a single-chain antibody against IL-10. In some embodiments, the genetically engineered bacterium or genetically engineered oncolytic virus is a tumor-targeting bacterium or tumor-targeting oncolytic virus that expresses an anti-IL-10 antibody, e.g., a single chain antibody. In some embodiments, the genetically engineered bacterium or genetically engineered oncolytic virus expresses an anti-IL-10 antibody, e.g., single chain antibody, under the control of a promoter that is activated by low-oxygen conditions. In some embodiments, the genetically engineered bacterium or genetically engineered oncolytic virus is a tumor-targeting bacterium or tumor-targeting oncolytic virus that expresses an anti-IL-10 antibody, e.g., a single chain antibody under the control of a promoter that is activated by low-oxygen conditions. In some embodiments, the genetically engineered bacterium or genetically engineered oncolytic virus expresses an anti-IL-10 antibody, e.g., single chain antibody, under the control of a promoter that is activated by hypoxic conditions, or by inflammatory conditions, such as any of the promoters activated by said conditions and described herein. In some embodiments, the genetically engineered bacteria or genetically engineered OV expresses an anti-IL-10 antibody, e.g., single chain antibody, under the control of a cancer-specific promoter, a tissue-specific promoter, or a constitutive promoter, such as any of the promoters described herein.

CCR4 also has an important role in normal and tumor immunity. C chemokine receptor 4 (CCR4) is important for regulating immune balance and is known to be expressed selectively on Th2 cells and effector Treg cells in both cancer tissues and in peripheral blood. In a subset of patients with CCR4+ T-cell leukemia/lymphoma, the tumor cells themselves function as regulatory T (Treg) cells, contributing to tumor survival in the face of host antitumor immune responses. In other types of cancers, the chemokines TARC/CCL17 and MDC/CCL22, specific ligands for CCR4 that are produced by tumor cells and the tumor microenvironment, attract CCR4+ Treg cells to the tumor, where they create a favorable environment for tumor escape from host immune responses. Studies have shown that tumor-infiltrating macrophages and tumor cells produce the chemokine (C—C motif) ligand 22 (CCL22), which chemoattracts Treg cells as well as effector T cells expressing C—C chemokine receptor type 4 (CCR4). Therefore, inhibition of CCR4 signaling has the potential to promote anti-tumor immune responses by selectively depleting Tregs and preventing them from migrating into the tumor microenvironment. In fact, in vivo and in vitro anti-CCR4 mAb treatment has been shown to selectively deplete effector Treg cells and efficiently induce tumor-antigen-specific $CD4^+$ and $CD8^+$ T cells.

In certain embodiments, the genetically engineered bacteria or genetically engineered oncolytic viruses produce an anti-cancer molecule that inhibits CCR4 and/or inhibits CCL17 and/or inhibits CCL22, for example, the genetically engineered microorganism may encode an antagonistic ligand for CCR4, and/or an antagonistic antibody directed against CCR4 and/or an antibody directed against CCL17 and/or an antibody directed against CCL22, e.g. a single-chain antibody against CCR4 and/or a single chain antibody against CCL17 and/or a single chain antibody against CCL22. In some embodiments, the genetically engineered bacterium or genetically engineered oncolytic virus is a tumor-targeting bacterium or tumor-targeting oncolytic virus that expresses an antagonistic CCR4 ligand and/or anti-CCR4 antibody and/or anti-CCL17 antibody and/or anti-CCL22 antibody, e.g., a single chain antibody. In some embodiments, the genetically engineered bacterium or genetically engineered oncolytic virus expresses an antagonistic ligand for CCR4 and/or anti-CCR4 antibody and/or an anti-CCL17 antibody and/or an antiCCL22 antibody, e.g., single chain antibody, under the control of a promoter that is activated by low-oxygen conditions. In some embodiments, the genetically engineered bacterium or genetically engineered oncolytic virus is a tumor-targeting bacterium or tumor-targeting oncolytic virus that expresses an an antagonistic ligand for CCR4 and/or anti-CCR4 antibody and/or an anti-CCL17 antibody and/or an antiCCL22 antibody, e.g., a single chain antibody under the control of a promoter that is activated by low-oxygen conditions. In some embodiments, the genetically engineered bacterium or genetically engineered oncolytic virus expresses an antagonistic ligand for CCR4 and/or anti-CCR4 antibody and/or an anti-CCL17 antibody and/or an antiCCL22 antibody, e.g., single chain antibody, under the control of a promoter that is activated by hypoxic conditions, or by inflammatory conditions, such as any of the promoters activated by said conditions and described herein. In some embodiments, the genetically engineered bacteria or genetically engineered OV expresses an antagonistic ligand for CCR4 and/or anti-CCR4 antibody and/or an anti-CCL17 antibody and/or an antiCCL22 antibody, e.g., single chain antibody, under the control of a cancer-specific promoter, a tissue-specific promoter, or a constitutive promoter, such as any of the promoters described herein.

Interleukin-27 (IL-27) is a member of the IL-12 family of heterodimeric cytokines that signals through receptors that are highly expressed on T cells and/or natural killer cells. IL-27 has been shown to suppress the development and differentiation of Th17 cells in inflammation and to induce a Treg-like activity in Th1 and Th2 effector cells. IL-27 has also been shown to induce IL-10 production and secretion in these Th1 and Th2 cells. These results were confirmed by additional studies which show that IL-27 can induce the production of IL-10 and IFN-gamma, and inhibit IL-17 secretion by anti-CD3, anti-CD28-activated human CD4$^+$ T cells. Also, IL-27-treated T cells suppresses the proliferation of CD4$^+$ T cells in an IL-10-dependent manner. Collectively, these studies indicate that IL-27 plays a role in the production of anti-inflammatory IL-10-producing T cell populations.

In certain embodiments, the genetically engineered bacteria or genetically engineered oncolytic viruses produce an anti-cancer molecule that indirectly or directly inhibits IL-27, for example, the genetically engineered microorganism may encode an antibody directed against IL-27, e.g. a single-chain antibody against IL-27. In some embodiments, the genetically engineered bacterium or genetically engineered oncolytic virus is a tumor-targeting bacterium or tumor-targeting oncolytic virus that expresses an anti-IL-27 antibody, e.g., a single chain antibody. In some embodiments, the genetically engineered bacterium or genetically engineered oncolytic virus expresses an anti-IL-27 antibody, e.g., single chain antibody, under the control of a promoter that is activated by low-oxygen conditions. In some embodiments, the genetically engineered bacterium or genetically engineered oncolytic virus is a tumor-targeting bacterium or tumor-targeting oncolytic virus that expresses an anti-IL-27 antibody, e.g., a single chain antibody under the control of a promoter that is activated by low-oxygen conditions. In some embodiments, the genetically engineered bacterium or genetically engineered oncolytic virus expresses an anti-IL-27 antibody, e.g., single chain antibody, under the control of a promoter that is activated by hypoxic conditions, or by inflammatory conditions, such as any of the promoters activated by said conditions and described herein. In some embodiments, the genetically engineered bacteria or genetically engineered OV expresses an anti-IL-27 antibody, e.g., single chain antibody, under the control of a cancer-specific promoter, a tissue-specific promoter, or a constitutive promoter, such as any of the promoters described herein.

Interleukin 35 (IL-35) is an IL-12 family cytokine produced by regulatory T cell (Tregs), but not effector T-cells and plays a role in immune suppression. It is a dimeric protein composed of IL-12α and IL-27β chains, which are encoded by two separate genes. IL-35 is an immunosuppressive cytokine, predominantly expressed by Tregs and is involved in suppression of anti-tumor immunity through its modulation of effector T cells, as well as myeloid cells. Upon secretion by Tregs, IL-35 suppresses inflammatory responses of immune cells. IL-35 has shown selective activities on different T-cell subsets, inducing proliferation of Treg cell populations but reducing the activity of $T_h17$ cell populations, resulting in a suppressive effect. Blocking the activity of IL-35 has the potential to reverse immune suppression in the tumor microenvironment and lead to a robust and effective anti-tumor immune response.

In certain embodiments, the genetically engineered bacteria or genetically engineered oncolytic viruses produce an anti-cancer molecule that indirectly or directly inhibits IL-35, for example, the genetically engineered microorganism may encode an antibody directed against IL-35, e.g. a single-chain antibody against IL-35. In some embodiments, the genetically engineered bacterium or genetically engineered oncolytic virus is a tumor-targeting bacterium or tumor-targeting oncolytic virus that expresses an anti-IL-35 antibody, e.g., a single chain antibody. In some embodiments, the genetically engineered bacterium or genetically engineered oncolytic virus expresses an anti-IL-35 antibody, e.g., single chain antibody, under the control of a promoter that is activated by low-oxygen conditions. In some embodiments, the genetically engineered bacterium or genetically engineered oncolytic virus is a tumor-targeting bacterium or tumor-targeting oncolytic virus that expresses an anti-IL-35 antibody, e.g., a single chain antibody, under the control of a promoter that is activated by low-oxygen conditions. In some embodiments, the genetically engineered bacterium or genetically engineered oncolytic virus expresses an anti-IL-35 antibody, e.g., single chain antibody, under the control of a promoter that is activated by hypoxic conditions, or by inflammatory conditions, such as any of the promoters activated by said conditions and described herein. In some embodiments, the genetically engineered bacteria or genetically engineered OV expresses an anti-IL-35 antibody, e.g., single chain antibody, under the control of a cancer-specific promoter, a tissue-specific promoter, or a constitutive promoter, such as any of the promoters described herein.

Colony stimulating factor 1 receptor (CSF1R, also known as macrophage colony-stimulating factor receptor, M-CSFR, Cluster of Differentiation 115, CD115) is a single pass type I membrane protein and acts as the receptor for colony stimulating factor 1 (CSF1), a cytokine which plays an essential role in regulating the survival, proliferation, differentiation, and function of macrophages and monocytes. Tumor-associated macrophages (TAM), monocytic myeloid-derived suppressor cells (MMDSC), and granulocytic MDSCs (G-MDSC) are considered drivers of the immunosuppressive tumor microenvironment. These leukocytes can also promote tumor cell proliferation, confer resistance to cytotoxic stress, and facilitate metastatic dissemination. Blockade of CSF1/CSF1R decreases the number of TAMs and reprograms remaining TAMs to support antigen presentation and bolster T-cell activation within the tumor microenvironment. This, in turn, leads to reduced immune suppression and elevated interferon responses, which restrain tumor progression (Yu Zhu, et al., Cancer Res Sep. 15, 2014 74).

In certain embodiments, the genetically engineered bacteria or genetically engineered oncolytic viruses produce an anti-cancer molecule that inhibits CSF1 and/or that inhibits CSF1R, for example, the genetically engineered microorganism may encode an antibody directed against CSF1 and/or an antibody directed against CSF1R, e.g. a single-chain antibody against CSF1 and/or a single-chain antibody against CSF1R. In some embodiments, the genetically engineered bacterium or genetically engineered oncolytic virus is a tumor-targeting bacterium or tumor-targeting oncolytic virus that expresses an anti-CSF1 antibody and/or an anti-CSF1R antibody, e.g., a single chain antibody. In some embodiments, the genetically engineered bacterium or genetically engineered oncolytic virus expresses an anti-CSF1 antibody and/or an anti-CSF1R antibody, e.g., single chain antibody, under the control of a promoter that is activated by low-oxygen conditions. In some embodiments, the genetically engineered bacterium or genetically engineered oncolytic virus is a tumor-targeting bacterium or tumor-targeting oncolytic virus that expresses an anti-CSF1 antibody and/or anti-CSF1R antibody, e.g., a single chain antibody, under the control of a promoter that is activated by low-oxygen conditions. In some embodiments, the genetically engineered bacterium or genetically engineered oncolytic virus expresses an anti-CSF1 antibody and/or an anti-CSF1R antibody, e.g., single chain antibody, under the control of a promoter that is activated by hypoxic conditions, or by inflammatory conditions, such as any of the promoters activated by said conditions and described herein. In some embodiments, the genetically engineered bacteria or genetically engineered OV expresses an anti-CSF1 antibody and/or an anti-CSF1R antibody, e.g., single chain antibody, under the control of a cancer-specific promoter, a tissue-specific promoter, or a constitutive promoter, such as any of the promoters described herein.

Monocyte chemoattractant protein 1 (MCP-1, CCL2) is a member of the cytokine/chemokine superfamily. CCL2 was first characterized as a chemokine which induces the migration of monocytes (Loberg et al., CCL2 is an important mediator of prostate cancer growth in vivo via regulation of macrophage infiltration. Neoplasia. 2007; 9:556-62). et al., 2010). Monocytes recruited to tumors through the CCL2-CCR2 axis are polarized to TAMs, contributing to tumor cell survival (McClellan et al., 2012). In addition, CCL2 has been found to exert a number of other chemotactic properties that include attraction of subsets of lymphocytes (including T-regs) and endothelial cells into sites of inflammation. CCL2 also directly affects T-cell function by inhibiting CD8+ T cell effector functions (Hu K. et a., Recombined CC chemokine ligand 2 into B16 cells induces production of Th2-dominated cytokines and inhibits melanoma metastasis. Immunology Letters. 2007; 113:19-28). Recently, an additional role for CCL2 as a regulator of MDSC accumulation and MDSC-mediated suppression of CD4+ and CD8+ T cells has been described in colorectal cancer. The outcomes in this study suggest an CCL2-MDSC immune checkpoint at the earliest stage of tumor development, which is susceptible to CCL2-directed blockade and potential CCL-2 directed therapy (Chun et al., CCL2 Promotes Colorectal Carcinogenesis by Enhancing Polymorphonuclear Myeloid-Derived Suppressor Cell Population and Function ⌘ Cell Reports 12, 244-257). In patients, CCL2 has been found at high levels in multiple tumor types which correlate with poor clinical outcome. Studies, such as those by Loberg et al., showed that systemic administration of anti-CCL2 neutralizing antibodies significantly retarded tumor growth. The use of a combination of two antibodies directed against the two mouse CCL2 mouse proteins has been recently shown to reduce tumorigenesis and metastasis in prostate cancer xenograft models. In particular, anti-CCL2 therapy has been suggested to be useful in combination with immunostimulatory therapy such as vaccine therapy (Fridlender, et al., Cancer Res. 2010 Jan. 1; 70(1): 109. CCL2 Blockade Augments Cancer Immunotherapy).

In certain embodiments, the genetically engineered bacteria or genetically engineered oncolytic viruses produce an anti-cancer molecule that inhibits CCL2, for example, the genetically engineered microorganism may encode an antibody directed against CCL2, e.g. a single-chain antibody against CCL2. In some embodiments, the genetically engineered bacterium or genetically engineered oncolytic virus is a tumor-targeting bacterium or tumor-targeting oncolytic virus that expresses an anti-CCL2 antibody, e.g., a single chain antibody. In some embodiments, the genetically engineered bacterium or genetically engineered oncolytic virus expresses an anti-CCL2 antibody, e.g., single chain antibody, under the control of a promoter that is activated by low-oxygen conditions. In some embodiments, the genetically engineered bacterium or genetically engineered oncolytic virus is a tumor-targeting bacterium or tumor-targeting oncolytic virus that expresses an anti-CCL2 antibody, e.g., a single chain antibody under the control of a promoter that is activated by low-oxygen conditions. In some embodiments, the genetically engineered bacterium or genetically engineered oncolytic virus expresses an anti-CCL2 antibody, e.g., single chain antibody, under the control of a promoter that is activated by hypoxic conditions, or by inflammatory conditions, such as any of the promoters activated by said conditions and described herein. In some embodiments, the genetically engineered bacteria or genetically engineered OV expresses an anti-CCL2 antibody, e.g., single chain antibody, under the control of a cancer-specific promoter, a tissue-specific promoter, or a constitutive promoter, such as any of the promoters described herein.

CD70 is a cytokine that is a type II transmembrane glycoprotein belonging to the tumor necrosis factor (TNF) superfamily of molecules. Upon binding of its ligand CD27, it promotes proliferation, survival and differentiation of cells. Expression of CD70 is normally restricted to activated T and B cells, but is expressed in certain tumor cells, and has been implicated in tumor cell and Treg cell survival through interaction with CD27. The constitutive expression of CD70 by tumor cells is thought to allow evasion of the immune system by increasing the amount of suppressive Tregs, by induction of T cell apoptosis and by skewing T cells towards T cell exhaustion. It has been shown that inhibition of CD70 can abolish its immune inhibitory effects in the tumor-microenvironment. (CD70: An emerging target in cancer immunotherapy, Jacobs et al., Pharmacology & Therapeutics, Volume 155, November 2015, Pages 1-10).

In certain embodiments, the genetically engineered bacteria or genetically engineered oncolytic viruses produce an anti-cancer molecule that inhibits CD70 and/or CD27, for example, the genetically engineered microorganism may encode an antibody directed against CD70 and/or CD27, e.g. a single-chain antibody against CD70 and/or a single-chain antibody against CD27. In some embodiments, the genetically engineered bacterium or genetically engineered oncolytic virus is a tumor-targeting bacterium or tumor-targeting oncolytic virus that expresses an anti-CD70 and/or an anti-CD27 antibody, e.g., a single chain antibody. In some embodiments, the genetically engineered bacterium or genetically engineered oncolytic virus expresses an anti-CD70 antibody and/or an anti-CD27 antibody, e.g., single chain antibody, under the control of a promoter that is activated under low oxygen conditions. In some embodiments, the genetically engineered bacterium or genetically engineered oncolytic virus is a tumor-targeting bacterium or tumor-targeting oncolytic virus that expresses an anti-CD70 antibody and/or anti-CD27 antibody, e.g., a single chain antibody under the control of a promoter that is activated by low-oxygen conditions. In some embodiments, the genetically engineered bacterium or genetically engineered oncolytic virus expresses an anti-CD70 antibody and/or an antiCD27 antibody, e.g., single chain antibody, under the control of a promoter that is activated by hypoxic conditions, or by inflammatory conditions, such as any of the promoters activated by said conditions and described herein. In some embodiments, the genetically engineered bacteria or genetically engineered OV expresses an anti-CD70 antibody and/or an anti-CD27 antibody, e.g., single chain antibody, under the control of a cancer-specific promoter, a tissue-specific promoter, or a constitutive promoter, such as any of the promoters described herein.

Three TGF-β isoforms (TGF-β1, TGF-β2, and TGF-β3) with similar function exist in mammals; TGF-β1 is the isoform predominantly expressed in the immune system. In addition to its direct effects on tumor cell proliferation and angiogenesis, TGF-β enables tumors to evade immune surveillance (see, e.g., Wrzesinski et al., Clin Cancer Res Sep. 15, 2007 13; 5262Transforming Growth Factor-β and the Immune Response: Implications for Anticancer Therapy). As a pleiotropic cytokine, TGF-β exerts its effects on multiple immune cell types. For example, TGF-β can block the production of IL-2, thereby blocking the proliferation of T cells and NK cells. In addition, TGF-β also controls T-cell effector functions by inhibiting the expression of CD8+ effector molecules, such as IFN-γ and perforin and also promotes the generation of Tregs. Finally, TGF-β is thought to negatively regulate regulates the antigen presentation function of differentiated dendritic cells.

In certain embodiments, the genetically engineered bacteria or genetically engineered oncolytic viruses produce an anti-cancer molecule that inhibits TGF-β, for example, the genetically engineered microorganism may encode a neutralizing antibody directed against TGF-β, e.g. a single-chain antibody against TGF-β. In some embodiments, the genetically engineered bacterium or genetically engineered oncolytic virus is a tumor-targeting bacterium or tumor-targeting oncolytic virus that expresses an anti-TGF-β antibody, e.g., a single chain antibody. In some embodiments, the genetically engineered bacterium or genetically engineered oncolytic virus expresses an anti-TGF-β antibody, e.g., single chain antibody, under the control of a promoter that is activated under low oxygen conditions. In some embodiments, the genetically engineered bacterium or genetically engineered oncolytic virus is a tumor-targeting bacterium or tumor-targeting oncolytic virus that expresses an anti-TGF-β antibody, e.g., a single chain antibody under the control of a promoter that is activated by low-oxygen conditions. In some embodiments, the genetically engineered bacterium or genetically engineered oncolytic virus expresses an anti-TGF-β antibody e.g., single chain antibody, under the control of a promoter that is activated by hypoxic conditions, or by inflammatory conditions, such as any of the promoters activated by said conditions and described herein. In some embodiments, the genetically engineered bacteria or genetically engineered OV expresses an anti-TGF-β antibody, e.g., single chain antibody, under the control of a cancer-specific promoter, a tissue-specific promoter, or a constitutive promoter, such as any of the promoters described herein.

Myeloid Derived Suppressor Cell Function

Accumulating evidence indicates that myeloid-derived suppressor cells (MDSCs) contribute to cancer immune evasion by suppressing T cell anti-tumor functions and modulating innate immune responses. In many cancers, increased MDSC numbers in the blood correlate with late stage and metastatic burden. MDSCs comprise a heterogeneous population of immature myeloid cells characterized by co-expression of CD11b and Gr-1 and lack features of mature macrophages and dendritic cells in tumor-bearing mice. MDSCs can be divided into two distinct sub-populations, differing in their gene expression profiles and immunosuppressive activities: monocytic MDSCs (Mo-MDSCs) and polymorphonuclear (PMN)-MDSCs, also known as granulocytic (G)-MDSCs (as described in e.g., Chun et al., CCL2 Promotes Colorectal Carcinogenesis by Enhancing Polymorphonuclear Myeloid-Derived Suppressor Cell Population and Function Cell Reports 12, 244-257). These two types of MDSC achieve immune suppression by different means: while both use argininase-1 for their suppressive activity, (PMN)-MDSCs produce high levels of ROS and little, if any, NO; while Mo-MDSCs produced high levels of NO, but little, if any, ROS. Expansion of MDSC in cancer is largely driven by soluble cancer derived cytokines and growth factors, including but not limited to, prostaglandins, GM-CSF, M-CSF, IL-1β, IL-6, VEGF, TGFβ, IL-10, IL-12, IL-13, Il-17, PGE2, and TNF. In most cases, JAK/Stat signaling is initiated as reviewed in Condamine et al., 2015 Annu Rev Med. 2015 Jan. 14; 66: 97-110. Regulation of Tumor Metastasis by Myeloid-derived Suppressor Cells, the contents of which is herein incorporated by reference in its entirety.

Mechanisms of MDSC suppression include generation of reactive oxygen species (ROS), Arg-1, and nitric oxide (NO). In addition, recent studies show that peroxynitrite (PNT), resulting from the reaction of superoxide with NO, can cause the nitration of T cell receptor-CD8 complex. This reduces the ability of the TCR to engage with peptide bound class I MHC and prevents the recognition of cancer cells by CD8+ T cells. Moreover, accelerated depletion of L-arginine and cysteine in the tumor microenvironment has been shown to reduce CD3ζ chain expression, diminish production of IL-2 and IFN-γ, and inhibit of T cell proliferation, Condamine et al., 2015 and references therein). Several studies showed the ability of M-MDSC to induce differentiation and/or proliferation of Tregs using various mechanisms (Condamine et al. 2015 and references therein). Of note, PMN-MDSC did not promote Treg differentiation, were able to inhibit TGF-β induced Treg generation or proliferation. MDSC also have the ability to recruit Tregs to the tumor site, and this ability is dependent on CCR5 (Condamine et al. 2015 and references therein).

In certain embodiments, the genetically engineered bacteria or genetically engineered oncolytic viruses produce an anti-cancer molecule that inhibits the activation, production, development, differentiation, activity and/or migration of MDSCs in the tumor microenvironment. In certain embodiments, the genetically engineered bacteria or genetically engineered oncolytic viruses produce an anti-cancer molecule that initiates, promotes or stimulates the destruction of MDSCs in the tumor microenvironment In certain embodiments, the genetically engineered bacteria or genetically engineered oncolytic viruses produce one or more anti-cancer molecules that inhibit one or more cytokines selected from M-CSF, IL-1β, IL-6, VEGF, TGFβ, IL-10, IL-13, Il-17, PGE2 and combinations thereof. For example, the genetically engineered microorganism may encode an antibody directed against a cytokine selected from M-CSF, IL-1β, IL-6, VEGF, TGFβ, IL-10, IL-13, Il-17, PGE2 and combinations thereof, e.g. a single-chain antibody against one or more of these cytokines. In some embodiments, the genetically engineered bacterium or genetically engineered oncolytic virus is a tumor-targeting bacterium or tumor-targeting oncolytic virus. In some embodiments, the genetically engineered bacterium or genetically engineered oncolytic virus expresses one or more of the above-described antibodies, e.g., single chain antibody, under the control of a promoter that is activated by low-oxygen conditions, activated by hypoxic conditions, or activated by inflammatory conditions, such as any of the promoters activated by said conditions and described herein. In some embodiments, the genetically engineered bacteria or genetically engineered OV expresses one or more of the above-described antibodies, e.g., single chain antibody, under the control of a cancer-specific promoter, a tissue-specific promoter, or a constitutive promoter, such as any of the promoters described herein.

V. Environmental pH and Lactic Acid

The anti-cancer immune response is influenced by the environmental pH; an acidic pH has been shown to inhibit the function of immune cells. Lowering the environmental pH to 6.0-6.5, as can be found in tumour masses, has been reported to lead to loss of T-cell function of human and murine tumour-infiltrating lymphocytes (eg impairment of cytolytic activity and cytokine secretion); the T-cell function could be completely restored by buffering the pH at physiological values. The primary cause responsible for the acidic pH and pH-dependent T-cell function-suppressive effect in a tumour micro-environment has been identified as lactic acid (as reviewed in Chio et al., J Pathol. 2013 August; 230(4): 350-355. Cancer-generated lactic acid: a regulatory, immunosuppressive metabolite?), the contents of which is herein incorporated by reference in its entirety. It has also been demonstrated that cancer-generated lactic acid and the resultant acidification of the micro-environment increase the expression of ARG1 in tumour-associated macrophages, characteristic of the M2 helper phenotype.

In some embodiments, the cassette encodes a payload, which can take up lactic acid and metabolize it in the bacterial cell. In some embodiments, a lactic acid metabolizing enzyme is secreted into the tumor microenvironment. In some embodiments, the genetically engineered bacterium or genetically engineered oncolytic virus are able to reduce the level of lactic acid in the tumor microenvironment. In some embodiments, the genetically engineered bacterium or genetically engineered oncolytic virus are able to import lactic acid from the tumor microenvironment. In some embodiments, the genetically engineered bacterium or genetically engineered oncolytic virus are able to metabolize lactic acid.

Inhibition of Phagocytosis Escape

CD47-SIRPα Pathway

Cancers have the ability to up-regulate the "don't eat me" signal to allow escape from endogenous "eat me" signals that were induced as part of programmed cell death and programmed cell removal, to promote tumor progression.

CD47 is a cell surface molecule implicated in cell migration and T cell and dendritic cell activation. In addition, CD47 functions as an inhibitor of phagocytosis through ligation of signal-regulatory protein alpha (SIRPα) expressed on phagocytes, leading to tyrosine phosphatase activation and inhibition of myosin accumulation at the submembrane assembly site of the phagocytic synapse. As a result, CD47 conveys a "don't eat me signal". Loss of CD47 leads to homeostatic phagocytosis of aged or damaged cells.

Elevated levels of CD47 expression are observed on multiple human tumor types, allowing tumors to escape the innate immune system through evasion of phagocytosis. This process occurs through binding of CD47 on tumor cells to SIRPα on phagocytes, thus promoting inhibition of phagocytosis and tumor survival.

Anti-CD47 antibodies have demonstrated pre-clinical activity against many different human cancers both in vitro and in mouse xenotransplantation models (Chao et al., Curr Opin Immunol. 2012 April; 24(2): 225-232. The CD47-SIRPα Pathway in Cancer Immune Evasion and Potential Therapeutic Implications, and references therein). In addition to CD47, SIRPα can also be targeted as a therapeutic strategy; for example, anti-SIRPα antibodies administered in vitro caused phagocytosis of tumor cells by macrophages (Chao et al., 2012).

In certain embodiments, the genetically engineered bacteria or genetically engineered oncolytic viruses produce one or more anti-cancer molecules that inhibit CD47 and/or inhibit SIRPα, for example, the genetically engineered microorganism may encode an antibody directed against CD47 and/or an antibody directed against SIRPα, e.g. a single-chain antibody against CD47 and/or a single-chain antibody against SIRPα. In some embodiments, the genetically engineered bacterium or genetically engineered oncolytic virus is a tumor-targeting bacterium or tumor-targeting oncolytic virus that expresses an anti-CD47 antibody and/or anti-SIRPα antibody, e.g., a single chain antibody. In some embodiments, the genetically engineered bacterium or genetically engineered oncolytic virus expresses an anti-CD47 antibody and/or an anti-SIRPα antibody, e.g., single chain antibody, under the control of a promoter that is activated by low-oxygen conditions. In some embodiments, the genetically engineered bacterium or genetically engineered oncolytic virus is a tumor-targeting bacterium or tumor-targeting oncolytic virus that expresses an anti-CD47 antibody and/or anti-SIRPα antibody, e.g., a single chain antibody under the control of a promoter that is activated by low-oxygen conditions. In some embodiments, the genetically engineered bacterium or genetically engineered oncolytic virus expresses an anti-CD47 antibody and/or an anti-SIRPα, e.g., single chain antibody, under the control of a promoter that is activated by hypoxic conditions, or by inflammatory conditions, such as any of the promoters activated by said conditions and described herein. In some embodiments, the genetically engineered bacteria or genetically engineered OV expresses an anti-CD47antibody and/ or an anti-SIRPα antibody, e.g., single chain antibody, under the control of a cancer-specific promoter, a tissue-specific promoter, or a constitutive promoter, such as any of the promoters described herein. In any of these embodiments, the genetically engineered microorganisms may also produce one or more anti-cancer molecules that are capable of stimulating Fc-mediated functions such as ADCC, and/or M-CSF and/or GM-CSF, resulting in a blockade of phagocytosis inhibition.

Phosphatidyl Serine Externalization

The redistribution of Phosphatidyl serine (PS) to the external face of the plasma membrane flags cells for their recognition, phagocytosis, and ultimate degradation by phagocytes (efferocytosis). Moreover, the interaction between PS-expressing cells and immune cells triggers immunosuppressive pathways that prevent both local and systemic immune activation. Although these pathways are used by apoptotic cells to quell potential immune sequalae against 'self', these same pathways are hijacked by tumors to evade the immune response.

PS is dysregulated in cancers, and along with the upregulation of PS receptors, provides potent immunosuppression in the tumor microenvironment. In the tumor microenvironment, pro-inflammatory and adaptive immune response are suppressed by several types of PS expressing immature tumor vasculature, tumor-derived exosomes, and tumor cells. Moreover, intra-tumoral DCs that bind and ingest PS-expressing cells maintain an immature phenotype preventing the expression of co-stimulatory molecules that are required for optimum functional antigen presentation and activation of T-cell responses. PS receptors, including the TAM and TIM family of receptors, are expressed on infiltrating myeloid-derived cells where they function to promote tissue homeostasis following inflammatory signaling. In the tumor microenvironment, these receptors are engaged by PS or PS bridging molecules resulting in the expression of immunosuppressive cytokines and the prevention of a productive anti-tumor immune response.

Systemic administration of Annexin A5 (AnxA5) or other PS ligands, PS-targeting antibodies, and agents targeting PS receptors have been shown to slow tumor progression (reviewed in Birge et al., Cell Death and Differentiation advance online publication 26 Feb. 2016; doi: 10.1038/cdd.2016.11Phosphatidylserine is a global immunosuppressive signal in efferocytosis, infectious disease, and cancer).

In certain embodiments, the genetically engineered bacteria or genetically engineered oncolytic viruses produce one or more anti-cancer molecules that inhibit PS and/or inhibit the PS receptor, for example, the genetically engineered microorganism may encode an antibody directed against PS and/or an antibody directed against the PS receptor, e.g. a single-chain antibody against PS and/or a single-chain antibody against the PS receptor. In some embodiments, the genetically engineered bacterium or genetically engineered oncolytic virus is a tumor-targeting bacterium or tumor-targeting oncolytic virus that expresses an anti-PS antibody and/or an anti-PS receptor antibody, e.g., a single chain antibody. In some embodiments, the genetically engineered bacterium or genetically engineered oncolytic virus expresses an anti-PS antibody and/or an anti-PS receptor antibody, e.g., single chain antibody, under the control of a promoter that is activated by low-oxygen conditions. In some embodiments, the genetically engineered bacterium or genetically engineered oncolytic virus is a tumor-targeting bacterium or tumor-targeting oncolytic virus that expresses an anti-PS antibody and/or an anti-PS receptor antibody, e.g., a single chain antibody under the control of a promoter that is activated by low-oxygen conditions.

In certain embodiments, the genetically engineered bacteria or genetically engineered oncolytic viruses produce one or more anti-cancer molecules that inhibit PS signaling through the PS receptor, for example, the genetically engineered microorganism may encode a PS receptor antagonist, e.g. an antagonistic P5 ligand. In certain embodiments, the P5 receptor antagonist is Annexin A5. In some embodiments, the genetically engineered bacterium or genetically engineered oncolytic virus is a tumor-targeting bacterium or tumor-targeting oncolytic virus that expresses an antagonistic P5 ligand. In some embodiments, the genetically engineered bacterium or genetically engineered oncolytic virus expresses an antagonistic P5 ligand under the control of a promoter that is activated by low-oxygen conditions. In some embodiments, the genetically engineered bacterium or genetically engineered oncolytic virus is a tumor-targeting bacterium or tumor-targeting oncolytic virus that expresses an antagonistic P5 ligand under the control of a promoter that is activated by low-oxygen conditions.

In some embodiments, the genetically engineered bacterium or genetically engineered oncolytic virus expresses an antagonistic ligand for P5 receptor and/or anti-PS antibody and/or an anti-PS receptor antibody, e.g., single chain antibody, under the control of a promoter that is activated by hypoxic conditions, or by inflammatory conditions, such as any of the promoters activated by said conditions and described herein. In some embodiments, the genetically engineered bacteria or genetically engineered OV expresses an antagonistic ligand for P5 receptor and/or anti-PS antibody and/or an anti-PS receptor antibody, e.g., single chain antibody, under the control of a cancer-specific promoter, a tissue-specific promoter, or a constitutive promoter, such as any of the promoters described herein.

Immune Suppression and Angiogenesis and Hypoxia/HIF Regulation

Neovascularization is critical for tumor development as tumors have to establish a blood supply in order to progress. Angiogenesis is the most prominent step in tumor neovascularization. The angiogenic process is regulated by a number of factors, which promote or inhibit endothelial cell activation. Pro-angiogenic factors include VEGF, fibroblast growth factor (FGF), and ANG family members. Angiostatic molecules include thrombospondin-1, endostatin and tumstatin, and certain CXCL chemokines. During tumor angiogenesis, dysregulation leads to an overabundance of pro-angiogenic factors, resulting in uninhibited sprouting and expansion of the endothelium. New vessels arise when such sprouts meet and anastamose, and subsequently vessels stabilize with the formation of a basement membrane and the recruitment of mural cells.

It has become clear that immune cells play a key pro-angiogenic role and are at least in part responsible for the short-lived response to angiogenesis inhibitors in the clinic (Rivera and Bergers, Trends Immunol. 2015 April; 36(4):240-9. Intertwined regulation of angiogenesis and immunity by myeloid cells). Hypoxic tumors drive the recruitment and infiltration of several innate immune cell populations through the secretion of a number of cytokines and growth factors. For example, tumor-derived VEGF, CSF-1, MCP-1, and SDF1α recruit macrophages, G-MDSCs and Mo-MDSCs; CXCL2 recruits angiogenic neutrophils and monocytes; ANG2 recruits angiogenic TIE2-expressing monocytes/macrophages (TEMs).

In certain embodiments, the present disclosure provides engineered microorganisms that produce one or more anti-cancer molecules that inhibit the activity of one or more of the following: VEGF, CXCR4/CXCL12, HIF-1 alpha, Galectin, Neutropilin and Tie2.

Additional cytokines secreted by tumor cells include IL-4 and IL-6, which induce the differentiation of infiltrating monocytes into angiogenic and immune-suppressive macrophages. Once recruited into the tumor microenvironment, MDSCs, TAMs, TEMs, and neutrophils secrete or liberate sequestered angiogenic factors, the most prevalent of which is VEGF. The proangiogenic activity of VEGF is predominantly caused through its interaction with VEGFR2 on endothelial cells. In addition, VEGF is also known to inhibit a number of different types of immune cells via multiple mechanisms. For example, VEGF binds to VEGFR1 on CD34$^+$ hematopoietic progenitors and inhibits differentiation into mature dendritic cells through inhibition of NF-κB-signaling, leading to defective antigen presentation (Oyama, et al. J. Immunol., 160 (1998), pp. 1224-1232; Vascular endothelial growth factor affects dendritic cell maturation through the inhibition of nuclear factor-kappa B activation in hemopoietic progenitor cells). In addition, VEGF also induces programmed death ligand 1 (PDL1) expression on dendritic cells inhibiting T cell activation and promoting self-tolerance. Furthermore, VEGF impedes T cell extravasation by limiting T cell adhesion to the luminal surfaces of blood vessels, inhibits the proliferation and cytotoxicity of cytotoxic T lymphocytes (CTLs), and stimulates the proliferation of T regulatory (Treg) cells (e.g., reviewed in Motz, et al., Nat. Rev. Immunol., 11 (2011), pp. 702-711; The parallel lives of angiogenesis and immunosuppression: cancer and other tales).

In certain embodiments, the genetically engineered bacteria or genetically engineered oncolytic viruses produce one or more anti-cancer molecules that inhibit VEGF. In some embodiments, the genetically engineered bacterium or genetically engineered oncolytic virus is a tumor-targeting bacterium or tumor-targeting oncolytic virus that expresses an anti-VEGF antibody, e.g., a single chain antibody. In some embodiments, the genetically engineered bacterium or genetically engineered oncolytic virus expresses an anti-VEGF antibody, e.g., single chain antibody, under the control of a promoter that is activated by low-oxygen conditions. In some embodiments, the genetically engineered bacterium or genetically engineered oncolytic virus is a tumor-targeting bacterium or tumor-targeting oncolytic virus that expresses an anti-VEGF antibody, e.g., a single chain antibody, under the control of a promoter that is activated by low-oxygen conditions. In certain embodiments, the genetically engineered bacteria or genetically engineered oncolytic viruses express an anti-VEGF antibody, e.g., single chain antibody, under the control of a promoter that is activated by hypoxic conditions, or by inflammatory conditions, such as any of the promoters activated by said conditions and described herein. In some embodiments, the genetically engineered bacteria or genetically engineered OV expresses an anti-VEGF antibody, under the control of a cancer-specific promoter, a tissue-specific promoter, or a constitutive promoter, such as any of the promoters described herein.

Bevacizumab (Avastin) Anti-VEGF:

```
Heavy Chain:
                                      SEQ ID NO: 124
EVQLVESGGGLVQPGGSLRLSCAASGYTFTNYGMNWVRQAPGKGLEWVG

WINTYTGEPTYAADFKRRFTFSLDTSKSTAYLQMNSLRAEDTAVYYCAK

YPHYYGSSHWYFDVWGQGTLVTVSSASTKGPSVFPLAPSSKSTSGGTAA

LGCLVKDYFPEPVTVSWNSGALTSGVHTFPAVLQSSGLYSLSSVVTVPS

SSLGTQTYICNVNHKPSNTKVDKKVEPKSCDKTHTCPPCPAPELLGGPS

VFLFPPKPKDTLMISRTPEVTCVVVDVSHEDPEVKFNWYVDGVEVHNAK

TKPREEQYNSTYRVVSVLTVLHQDWLNGKEYKCKVSNKALPAPIEKTIS

KAKGQPREPQVYTLPPSREEMTKNQVSLTCLVKGFYPSDIAVEWESNGQ

PENNYKTTPPVLDSDGSFFLYSKLTVDKSRWQQGNVFSCSVMHEALHNH

YTQKSLSLSPGK

Light Chain:,
                                      SEQ ID NO: 125
DIQMTQSPSSLSASVGDRVTITCSASQDISNYLNWYQQKPGKAPKVLIY

FTSSLHSGVPSRFSGSGSGTDFTLTISSLQPEDFATYYCQQYSTVPWTF

GQGTKVEIKRTVAAPSVFIFPPSDEQLKSGTASVVCLLNNFYPREAKVQ

WKVDNALQSGNSQESVTEQDSKDSTYSLSSTLTLSKADYEKHKVYACEV

THQGLSSPVTKSFNRGEC
```

Hypoxia-inducible factor 1-alpha, also known as HIF-1-alpha, is a subunit of a heterodimeric transcription factor hypoxia-inducible factor 1 (HIF-1) that is encoded by the HIF1A gene. HIF-1 is known to induce transcription of more than 60 genes, including VEGF and erythropoietin that are involved in angiogenesis and erythropoiesis, which assist in promoting and increasing oxygen delivery to hypoxic regions. HIF-1 also induces transcription of genes involved in cell proliferation and survival, as well as glucose and iron metabolism. HIF-1 responds to systemic oxygen levels by undergoing conformational changes, and associates with HRE regions of promoters of hypoxia-responsive genes to induce transcription.

Hypoxia within the tumor microenvironment is a key regulator of angiogenesis. This regulation is mediated by the hypoxia-inducible factor (HIF) family of transcription factors. HIFs inter alia orchestrate the metabolic and vascular adaptation to low oxygen. HIF stabilization leads to an upregulation of various proangiogenic growth factors and chemokines including VEGF, PlGF, and ANG2, resulting directly in vessel growth as well as the recruitment of bone-marrow-derived myeloid cells (C. Murdoch, et al. Blood, 104 (2004), pp. 2224-2234; Mechanisms regulating the recruitment of macrophages into hypoxic areas of tumors and other ischemic tissues). VEGF, induced by HIF, activates endothelial cells and attracts myeloid cells, promoting angiogenic properties in these cells (Avraham-Davidi, et al.; J. Exp. Med., 210 (2013), pp. 2611-2625). HIF-1 alpha also induces FoxP3, the Treg transcriptional master regulator. FOXP3 (forkhead box P3) contains putative hypoxia response elements within its promoter, rendering its expression sensitive to HIF-1α activation (Clambey, et al. Proc. Natl. Acad. Sci. U.S.A., 109 (2012), pp. E2784-E2793; Hypoxia-inducible factor-1 alpha-dependent induction of FoxP3 drives regulatory T-cell abundance and function during inflammatory hypoxia of the mucosa).

HIF-1 is overexpressed in many human cancers. HIF-1 overexpression is heavily implicated in promoting tumor growth and metastasis through its role role in initiating angiogenesis and regulating cellular metabolism to overcome hypoxia. Significant HIF-1 expression has been noted in most solid tumors studied, including colon, breast, pancreas, kidney, prostate, ovary, brain, and bladder cancers. Clinically, elevated HIF-1a levels in a number of cancers, including cervical cancer, non-small-cell lung carcinoma, breast cancer (LV-positive and negative), oligodendroglioma, oropharyngeal cancer, ovarian cancer, endometrial cancer, esophageal cancer, head and neck cancer, and stomach cancer, have been associated with aggressive tumor progression.

In certain embodiments, the genetically engineered bacteria or genetically engineered oncolytic viruses produce one or more anti-cancer molecules that inhibit HIF, e.g., HIF-1. In some embodiments, the genetically engineered bacterium or genetically engineered oncolytic virus is a tumor-targeting bacterium or tumor-targeting oncolytic virus that expresses an anti-HIF-1 antibody, e.g., a single chain antibody. In some embodiments, the genetically engineered bacterium or genetically engineered oncolytic virus expresses an anti-HIF antibody, e.g., single chain antibody, under the control of a promoter that is activated by low-oxygen conditions. In some embodiments, the genetically engineered bacterium or genetically engineered oncolytic virus is a tumor-targeting bacterium or tumor-targeting oncolytic virus that expresses an anti-HIF antibody, under the control of a promoter that is activated by low-oxygen conditions. In certain embodiments, the genetically engineered bacteria or genetically engineered oncolytic viruses express an anti-HIF antibody, e.g., single chain antibody, under the control of a promoter that is activated by hypoxic conditions, or by inflammatory conditions, such as any of the promoters activated by said conditions and described herein. In some embodiments, the genetically engineered bacteria or genetically engineered OV expresses an anti-HIF antibody, e.g., single chain antibody, under the control of a cancer-specific promoter, a tissue-specific promoter, or a constitutive promoter, such as any of the promoters described herein. In any of these embodiments, the anti-HIF antibody is an anti-HIF-1 antibody. In any of these embodiments, the anti-HIF antibody is an anti-HIF1-alpha (anti-HIF-1α antibody).

Semaphorin3A (SEMA3A) is another hypoxia-induced factor in tumors that is implicated in macrophage recruitment and subsequent angiogenesis. SEMA3A interacts with the transmembrane guidance protein neuropilin 1 (NRP1) on TAMs, leading to VEGFR1 activation and migration into the hypoxic tumor microenvironment (Rivera and Bergers, 2015). Upon arrival, NRP1 is no longer expressed, leading to a loss of their migratory phenotype. TAMs are then reprogrammed to an angiogenic and immune-suppressive phenotype, and produce immune suppressive and pro-angiogenic factors, including ARG1, CCL22, IL-10, VEGF, SEMA3A, and MMP-9 (A. Casazza, et al. Cancer Cell, 24 (2013), pp. 695-709 Impeding macrophage entry into hypoxic tumor areas by Sema3A/Nrp1 signaling blockade inhibits angiogenesis and restores antitumor immunity). The Neuropilin-1 (NRP1) and Neuropilin-2 (NRP2) receptors are transmembrane glycoproteins, and predominantly co-receptors for semaphorins and also function as receptors for some forms of vascular endothelial growth factor (VEGF). For example, VEGF165 binds to both NRP1 and to NRP2.

In certain embodiments, the genetically engineered bacteria or genetically engineered oncolytic viruses produce one or more anti-cancer molecules that inhibit NRP1, NRP2, and/or semaphorin3A. In some embodiments, the genetically engineered bacterium or genetically engineered oncolytic virus is a tumor-targeting bacterium or tumor-targeting oncolytic virus that expresses an anti-NRP1 antibody and/or an anti-NRP2 antibody, and/or an anti-semaphorin3A antibody, e.g., a single chain antibody. In some embodiments, the genetically engineered bacterium or genetically engineered oncolytic virus expresses an anti-NRP1 antibody and/or an anti-NRP2 antibody, and/or an anti-semaphorin3A antibody, e.g., single chain antibody, under the control of a promoter that is activated by low-oxygen conditions. In some embodiments, the genetically engineered bacterium or genetically engineered oncolytic virus is a tumor-targeting bacterium or tumor-targeting oncolytic virus that expresses an anti-anti-NRP1 antibody and/or an anti-NRP2 antibody, and/or an anti-semaphorin3A antibody, under the control of a promoter that is activated by low-oxygen conditions. In certain embodiments, the genetically engineered bacteria or genetically engineered oncolytic viruses expresses an anti-NRP1 antibody and/or an anti-NRP2 antibody, and/or an anti-semaphorin3A antibody, e.g., single chain antibody, under the control of a promoter that is activated by hypoxic conditions, or by inflammatory conditions, such as any of the promoters activated by said conditions and described herein. In some embodiments, the genetically engineered bacteria or genetically engineered OV expresses an anti-NRP1 antibody and/or an anti-NRP2 antibody, and/or an anti-semaphorin3A antibody, e.g., single chain antibody, under the control of a cancer-specific promoter, a tissue-specific promoter, or a constitutive promoter, such as any of the promoters described herein. In any of these embodiments, the antibody is an anti-NRP1 antibody.

Additionally, HIF-1α induces CXCL12 (SDF1α) and its receptor CXCR4, both of which are implicated in the retention of myeloid cells. Recent studies provide strong evidence for the role of the chemokine receptor CXCR4 in the maintenance, dissemination, and consequent metastatic colonization of cancer initiating cells (or cancer stem cells) (Gil et al., J Immunol. 2014; 193(10):5327-37; CXCL12/ CXCR4 blockade by oncolytic virotherapy inhibits ovarian cancer growth by decreasing immunosuppression and targeting cancer-initiating cells, and references therein). In ovarian cancer, signals mediated by the CXCL12/CXCR4 axis are centrally involved in progression, as CXCL12 can stimulate ovarian cancer cell migration and invasion through extracellular matrix. CXCL12 produced by tumor tissue and surrounding stroma stimulates VEGF-mediated angiogenesis and the recruitment of endothelial progenitor cells from the bone marrow (Gil et al., and references therein). CXCL12 also was shown to recruit suppressive myeloid cells and dendritic cells at tumor sites and induce intratumoral Treg localization (Gil et al., and references therein). In the study described by Gil et al., oncolytic vaccinia virus (OVV) expressing CXCR4 antagonist metastatic spread of tumors and improved overall survival compared with oncolysis alone in an ovarian cancer model (Gil et al., J Immunol. 2014 15; 193(10):5327-37; CXCL12/CXCR4 blockade by oncolytic virotherapy inhibits ovarian cancer growth by decreasing immunosuppression and targeting cancer-initiating cells). Expression of this receptor in cancer cells has been linked to metastasis to tissues containing a high concentration of CXCL12, such as lungs, liver and bone marrow.

In certain embodiments, the genetically engineered bacteria or genetically engineered oncolytic viruses produce one or more anti-cancer molecules that inhibit CXCR4/CXCL12 receptor/ligand binding. Thus, the genetically engineered bacteria or genetically engineered oncolytic viruses produce one or more anti-cancer molecules that inhibit CXCR4 and/or CXCL12. In some embodiments, the genetically engineered bacterium or genetically engineered oncolytic virus is a tumor-targeting bacterium or tumor-targeting oncolytic virus that expresses an anti-CXCR4 antibody (antagonistic) and/or an anti-CXCL12 antibody, e.g., a single chain antibody. In some embodiments, the genetically engineered bacterium or genetically engineered oncolytic virus expresses an anti-CXCR4 antibody (antagonistic) and/ or an anti-CXCL12 antibody, e.g., single chain antibody, under the control of a promoter that is activated by low-oxygen conditions. In some embodiments, the genetically engineered bacterium or genetically engineered oncolytic virus is a tumor-targeting bacterium or tumor-targeting oncolytic virus that expresses an anti-CXCR4 antibody (antagonistic) and/or an anti-CXCL12 antibody, under the control of a promoter that is activated by low-oxygen conditions. In certain embodiments, the genetically engineered bacteria or genetically engineered oncolytic viruses expresses an anti-CXCR4 antibody (antagonistic) and/or an anti-CXCL12 antibody, e.g., single chain antibody, under the control of a promoter that is activated by hypoxic conditions, or by inflammatory conditions, such as any of the promoters activated by said conditions and described herein. In some embodiments, the genetically engineered bacteria or genetically engineered OV expresses an anti-CXCR4 antibody (antagonistic) and/or an anti-CXCL12 antibody, e.g., single chain antibody, under the control of a cancer-specific promoter, a tissue-specific promoter, or a constitutive promoter, such as any of the promoters described herein. In any of these embodiments, the antibody is an anti-NRP1 antibody.

Galectins, a family of at least 15 β-galactoside-binding proteins, are involved in growth development as well as cancer progression and metastasis._Galectins are classified into three types: proto, chimera, and tandem repeat. Prototype galectins (Galectins-1, -2, -5, -7, -10, -11, -13, -14, and -15) contain one carbohydrate-recognition domain (CRD)

per subunit. Tandem repeat-type galectins (eg, galectins-4, -6, -8, -9, and -12) contain two CRDs joined by a linker peptide. Galectin-3, the most studied member of the family, is the only representative of the chimera-type galectin, which has one CRD at the C-terminal end. Galectin-3 is expressed in many tumors and possibly plays an important role in tumor progression. Recent studies revealed that galectin-3 inter alia may have immunosuppressive properties and can induce apoptosis of activated T-cells or is responsible for deficient T-cell functions (see, e.g., Ahmed et al., Clin. Med. Insights Oncol. 2015; 9: 113-121; Galectin-3 as a Potential Target to Prevent Cancer Metastasis). Cell surface glycoproteins, such as CD29, CD7, CD95, CD98, and T-cell receptor have been shown to associate with galectin-3, which may mediate induction of apoptosis by extracellular galectin-3. For example, extracellular galectin-3 binds to the CD29/CD7 complex, which triggers the activation of an intracellular apoptotic signaling cascade followed by mitochondrial cytochrome c release and activation of caspase-3 (see Ahmed et al., and references therein). Additionally, several studies suggest that galectin-3 promotes tumor angiogenesis and metastasis in many cancers. Disruption of galectin-3 expression could impair tumoral angiogenesis by reducing VEGF secretion from TGFβ1-induced TAMs (Machado et al., Cancer Med. 2014 April; 3(2): 201-14. Galectin-3 disruption impaired tumoral angiogenesis by reducing VEGF secretion from TGFβ1-induced macrophages). Galectin-1 prolongs cell-surface retention of VEGF receptor 2 (VEGFR2) and stimulates VEGF-independent tumor angiogenesis.

In certain embodiments, the genetically engineered bacteria or genetically engineered oncolytic viruses produce one or more anti-cancer molecules that inhibit Galectin-3 and/or Galectin-1. In some embodiments, the genetically engineered bacterium or genetically engineered oncolytic virus is a tumor-targeting bacterium or tumor-targeting oncolytic virus that expresses an anti-Galectin-3 antibody and/or an anti-Galectin-1 antibody, e.g., a single chain antibody. In some embodiments, the genetically engineered bacterium or genetically engineered oncolytic virus expresses an anti-Galectin-3 antibody and/or an anti-Galectin-1 antibody, e.g., single chain antibody, under the control of a promoter that is activated by low-oxygen conditions. In some embodiments, the genetically engineered bacterium or genetically engineered oncolytic virus is a tumor-targeting bacterium or tumor-targeting oncolytic virus that expresses an anti-Galectin-3 antibody and/or an anti-Galectin-1 antibody, e.g., a single chain antibody, under the control of a promoter that is activated by low-oxygen conditions. In certain embodiments, the genetically engineered bacteria or genetically engineered oncolytic viruses express an anti-Galectin-3 antibody and/or an anti-Galectin-1 antibody, e.g., single chain antibody, under the control of a promoter that is activated by hypoxic conditions, or by inflammatory conditions, such as any of the promoters activated by said conditions and described herein. In some embodiments, the genetically engineered bacteria or genetically engineered OV expresses an anti-Galectin-3 antibody and/or an anti-Galectin-1 antibody, e.g., single chain antibody, under the control of a cancer-specific promoter, a tissue-specific promoter, or a constitutive promoter, such as any of the promoters described herein.

TIE-1 and TIE-2 comprise the cell-surface receptors that bind and are activated by the angiopoietins, Ang1, Ang2, Ang3, and Ang4. The angiopoietins are protein growth factors required for the formation of blood vessels (angiogenesis). Ang1 and Ang4 function as agonistic or activating ligands for Tie2, whereas Ang2 and Ang3 behave as competitive antagonists. TIE2-expressing monocytes/macrophages (TEMs) are a highly-angiogenic and immune-suppressive tumor infiltrating macrophage subpopulation that expresses the angiopoietin receptor TIE2 and are often in juxtaposition to blood vessels through endothelial cell expression of the TIE2 ligand ANG2 (TIE2 can either bind ANG1 to resulting in vessel stabilization, or TIE2, opposing stabilization). The immunosuppressive effect of TEMs results from their ability to secrete IL-10, which inhibits T cell activation and stimulates the expansion of Tregs.

In certain embodiments, the genetically engineered bacteria or genetically engineered oncolytic viruses produce one or more anti-cancer molecules that inhibit Tie-2. In some embodiments, the genetically engineered bacterium or genetically engineered oncolytic virus is a tumor-targeting bacterium or tumor-targeting oncolytic virus that expresses an anti-Tie-2 antibody and/or an anti-Ang1 antibody and/or an anti-Ang4 antibody, e.g., a single chain antibody. In some embodiments, the genetically engineered bacterium or genetically engineered oncolytic virus expresses an anti-Tie-2 antibody and/or an anti-Ang1 antibody and/or an anti-Ang4 antibody, e.g., single chain antibody, under the control of a promoter that is activated by low-oxygen conditions. In some embodiments, the genetically engineered bacterium or genetically engineered oncolytic virus is a tumor-targeting bacterium or tumor-targeting oncolytic virus that expresses an anti-Tie-2 antibody, and/or an anti-Ang1 antibody an/or an anti-Ang4 antibody, e.g., a single chain antibody, under the control of a promoter that is activated by low-oxygen conditions. In certain embodiments, the genetically engineered bacteria or genetically engineered oncolytic viruses express an anti-Tie-2 antibody and/or an anti-Ang1 antibody and/or an anti-Ang4 antibody, e.g., single chain antibody, under the control of a promoter that is activated by hypoxic conditions, or by inflammatory conditions, such as any of the promoters activated by said conditions and described herein. In some embodiments, the genetically engineered bacteria or genetically engineered OV expresses an anti-Tie-2 antibody and/or an anti-Ang1 antibody and/or an anti-Ang4 antibody, e.g., single chain antibody, under the control of a cancer-specific promoter, a tissue-specific promoter, or a constitutive promoter, such as any of the promoters described herein.

VEGFR-2 appears to be the most important receptor in VEGF-induced mitogenesis and permeability. Receptor activation during angiogenesis induces the production of platelet-activating factor (PAF) by endothelial cells, stimulates their mitosis and migration, and increases vascular permeability. PAF promotes the expression of potent angiogenic factors and chemokines, including acid fibroblast factor, basic fibroblast growth factor (bFGF), and macrophage inflammatory protein 2 (Hoeben et al., Pharmacological Reviews vol. 56 no. 4 549-580; Vascular Endothelial Growth Factor and Angiogenesis.

In certain embodiments, the genetically engineered bacteria or genetically engineered oncolytic viruses produce one or more anti-cancer molecules that inhibit VEGFR-2. In some embodiments, the genetically engineered bacterium or genetically engineered oncolytic virus is a tumor-targeting bacterium or tumor-targeting oncolytic virus that expresses an anti-VEGFR-2 antibody, e.g., a single chain antibody. In some embodiments, the genetically engineered bacterium or genetically engineered oncolytic virus expresses an anti-VEGFR-2 antibody, e.g., single chain antibody, under the control of a promoter that is activated by low-oxygen conditions. In some embodiments, the genetically engineered bacterium or genetically engineered oncolytic virus is a tumor-targeting bacterium or tumor-targeting oncolytic virus that expresses an anti-VEGFR-2 antibody, e.g., a single chain antibody, under the control of a promoter that is activated by low-oxygen conditions. In certain embodiments, the genetically engineered bacteria or genetically engineered oncolytic viruses express an anti-VEGFR-2 antibody, e.g., single chain antibody, under the control of a promoter that is activated by hypoxic conditions, or by inflammatory conditions, such as any of the promoters activated by said conditions and described herein. In some embodiments, the genetically engineered bacteria or genetically engineered OV expresses an anti-VEGFR-2 antibody, e.g., single chain antibody, under the control of a cancer-specific promoter, a tissue-specific promoter, or a constitutive promoter, such as any of the promoters described herein.

Activation of an Innate Immune Response

As discussed herein, the microroganisms of the present disclosure can activate an innate immune response through the presence of PAMPs and DAMPs, which are agonists for PRRs (e.g., TRLs and RLRs) found on immune cells and tumor cells in the tumor microenvironment. Thus, in certain embodiments, the microorganisms of the present disclosure activate an innate immune response when delivered systemically or delivered intratumorally to the tumor site. In these embodiments, the microorganism naturally expresses a PRR agonist, such as one or more PAMPs or DAMPs. Examples of PAMPs and DAMPs are shown in Takeuchi et al., Cell, (2010), 140:805-820. In certain embodiments, the microorganism is an engineered bacteria. In certain embodiments, the microorganism is an engineered oncolytic virus.

In some aspects, the engineered microorganism, e.g., engineered bacteria or engineered oncolytic virus, is engineered to produce one or more PRR agonist(s) that activate or have a stimulatory effect on tumor-infiltrating APCs (e.g., B cells, dendritic cells (DCs), tumor-associated macrophages (TAMs), and other myeloid derived suppressor cells). Examples of suitable PRR agonists include those that stimulate proinflammatory cytokine expression and/or secretion, upregulate costimulatory molecules on the surface of APCs (e.g., CD40, CD80, DC86), stimulate the expression of costimulatory agonists (CD40L), stimulate the antigen presentation and priming of cytotoxic CD8+ Tcells, stimulate the production of pDCs, stimulate TRAIL/DRS, stimulate the production of major histocompatibility complex (MHC) class II molecules (which present processed antigens, derived primarily from exogenous sources, to CD4(+) T-lymphocytes), promote the survival of cytotoxic CD8+ Tcells, and/or promote the activation of B cells and monocytes.

In certain embodiments, the engineered microorganism produces one or more TLR agonists, for example, one or more TLR1 agonists, TLR2 agonists, TLR3 agonists, TLR4 agonists, TLR5 agonists, TLR6 agonists, TLR7 agonists, TLR8 agonists, TLR9 agonists, and TRL10 agonists. For example, in certain embodiments, the engineered microorganism produces a CpG oligonucleotide (CpG ODN). Toll-like receptor 9 (TLR9) recognizes specific unmethylated CpG motifs prevalent in microbial but not vertebrate genomic DNA leading to innate and acquired immune responses. Microbial DNA immunostimulatory effects can be mimicked by synthetic oligodeoxynucleotides containing these CpG motifs (CpG ODNs). CpG ODN can have a direct cytotoxic effect against TLR-9 positive Bcell lymphoma tumor cells, but will also stimulate the antigen-presenting ability of the remaining tumor B cells, thereby assisting in the generation of an antitumor immune response. (Song et al., J Immunol, 2007, 179:2493-500; Jahrsdorfer et al., J Leukoc Biol, 2001, 69:81-88). The cytokines released upon CpG ODN delivery can stimulate antigen presentation and priming of cytotoxic CD8+ Tcells via the expression of CD40L (Sharma et al., Immunity, 2010, 33:942-54).

In certain embodiments, the engineered microorganism of the present disclosure, e.g. engineered bacteria or engineered oncolytic virus, are engineered to produce one or more C-type lectin receptor agonist(s). In certain embodiments, the engineered microorganism of the present disclosure is engineered to produce one or more cytoplasmic (intracellular) PRR(s) agonists. In certain embodiments, the engineered microorganism of the present disclosure is engineered to produce one or more nucleotide oligomerization (NOD) like receptor (NLR) agonists. In certain embodiments, the engineered microorganism of the present disclosure is engineered to produce one or more retinoic acid-inducible gene I (RIG-I) like receptor (RLR) agonists. In certain embodiments, the engineered microorganism of the present disclosure is engineered to produce one or more secreted PRR agonists.

Lytic Peptides

The bacteria and oncolytiv viruses of the present disclosure, by themselves, will result in cell lysis at the tumor site due to the presence of PAMPs and DAMPs, which will initiate an innate immune response. In addition, some bacteria and oncolytic viruses have the added feature of being lytic microorganisms with the ability to lyse tumor cells. Thus, in some embodiments, the engineered microorganisms, e.g., engineered bacteria and OVs, produce natural or native lytic peptides. Examples of lytic peptides are provided in Gaspar et al., Frontiers in Microbiology, 4(294):1-16 (2013), Schweizer, European J Pharm, 2009, 625:190-194; Harris et al., Medicinal Research Reviews, 2013, 33:190-234, and Nallar et al., Cytokine (January 2016) (in press). In some embodiments, the bacteria and oncolytic viruses can be further engineered to produce one or more cytotoxic molecules, e.g., lytic peptides that have the ability to lyse cancer or tumor cells locally in the tumor microenvironment upon delivery to the tumor site. Upon cell lysis, the tumor cells release tumor-associated antigens that serve to promote an adaptive immune response. The presence of PAMPs and DAMPs promote the maturation of antigen-presenting cells, such as dendritic cells, which activate antigen-specific CD4+ and CD8+ T cell responses. Thus, not only does the delivery of a lytic peptide to the tumor site serve to kill the tumor cell locally, it also exposes tumor associated antigens and neoantigens to antigen presenting cells, leading to immune-mediated antitumor responses. Such neo-antigens can be taken up by local APCs in the context of a pro-inflammatory environment, which can trigger an immune response against the neo-antigen, killing the antigen-expressing cancer cells, including distant cancer cells not exposed to the bacteria or virus.

Thus, in some embodiments, the genetically engineered bacteria or genetically engineered viruses are capable of producing one or more cytotoxin(s). In some embodiments, the genetically engineered bacteria or genetically engineered viruses are capable of producing one or more lytic peptide molecule(s), such as any of the cytotoxins and lytic peptides provided herein. In certain embodiments, the genetically engineered bacteria or genetically engineered oncolytic viruses produce one or more cytotoxins and/or lytic peptides, e.g. one or more of the peptides provided herein. In some embodiments, the genetically engineered bacterium or genetically engineered oncolytic virus is a tumor-targeting bacterium or tumor-targeting oncolytic virus that expresses one or more cytotoxins and/or lytic peptides. In some embodiments, the genetically engineered bacterium or genetically engineered oncolytic virus expresses one or more cytotoxins and/or one or more lytic peptides, under the control of a promoter that is activated by low-oxygen conditions. In some embodiments, the genetically engineered bacterium or genetically engineered oncolytic virus is a tumor-targeting bacterium or tumor-targeting oncolytic virus that expresses one or more cytotoxins and/or one or more lytic peptides under the control of a promoter that is activated by low-oxygen conditions. In some embodiments, the genetically engineered bacterium or genetically engineered oncolytic virus expresses one or more cytotoxins and/or one or more lytic peptides, under the control of a promoter that is activated by hypoxic conditions, or by inflammatory conditions, such as any of the promoters activated by said conditions and described herein. In some embodiments, the genetically engineered bacteria or genetically engineered OV expresses one or more cytotoxins and/or one or more lytic peptides, under the control of a cancer-specific promoter, a tissue-specific promoter, or a constitutive promoter, such as any of the promoters described herein.

Lytic peptides are small cationic molecules that are capable of disrupting and permeating cell membranes, which disruption occurs through different modes, including pore formation in the lipid membrane, thinning of the membrane bilayer, membrane dissolution, or lipid-peptide domain formation. Some lytic peptides are capable of intracellular targeting and can bind to nucleic acids and proteins, as well as have immunomodulatory activities. In addition, lytic peptides can have cytotoxic activity against cancer cells, which may occur via membranolytic or non-membranolytic mechanisms. Thus, lytic peptides serve at least two functions (1) to kill cancer cells and (2) to release cancer cell antigens to be presented to APCs and drive anti-tumor selective immune responses. Gaspar et al., Frontiers in Microbiology, 4(294):1-16 (2013). Forced lysis of the bacteria or virus also allow local release of the immune modulator(s). Engineering bacteria or virus to produce one or more lytic peptide molecules provides induction of immunogenic cell death, as the bacteria or virus act as adjuvant for stimulating an innate immune response. The integration of cytotoxins (lytic peptides) to stimulate immunogenic cell death can provide the tumor microenvironment with antigens to trigger an immune response.

In some embodiments, the genetically engineered bacteria or genetically engineered viruses comprise sequence encoding one or more lytic peptide molecules. Lists of cytotoxins and lytic peptides, and their corresponding anti-cancer activities, can be found in Schweizer, European J Pharm, 2009, 625:190-194; Gaspar et al., Frontiers in Microbiology, 2013, 4:294 doi:10.3389/fmicb.2013.00294; and Harris et al., Medicinal Research Reviews, 2013, 33:190-234. A few exemplary peptides are provided herein, but it is not meant to be an exhaustive list.

Exemplary peptides shown to target and eliminate tumor cells include, but are not limited to D-peptide A, D-peptide B, D-peptide C, D-peptide D, DK6L9, NRC-03, NRC-07, Gomesin, Hepcidin TH2-3, Dermaseptin B2, PTP7, MGA2, HNP-1, Tachyplasin, Temporin-10Ea, NK-2, Bovine lactoferrin B6, Tachyplasin, and Cecropin CB1.

In one embodiment, the lytic peptide molecule disrupts or lyses a cell membrane. Examples of such lytic peptide molecules include, but are not limited to, D-peptide A, D-peptide B, D-peptide C, D-peptide D, NRC-03, NRC-07, Polybia-MPI, Hepcidin TH2-3, SVS-1, Epinecidin-1, Temporin-10Ea, melittin (GIGAVLKVLTTGLPAL-ISWIKRKKQQ), LL-37 LLGDFFRK-SKEKIGKEFKRIVQRIKDFLRNLVPRTES), cecropin B (KWKVFKKIEKMGRNIRNGIVKAGPAIAVLGEAKAL), and Magainin 2 (GIGKFLHSAKKFGKAFVGEEIMNS).

In one embodiment, the lytic peptide molecule causes cell necrosis. Examples of such lytic peptide molecules include, but are not limited to, D-K6L9, MPI-1, Dermaseptin B2, MG2A, A9K, Hectate, and Phor14, Phor21, and Dermaceptin B2.

In one embodiment, the lytic peptide molecule induces cell apoptosis. Examples of such lytic peptide molecules include, but are not limited to, biforin IIb, PTP7, BEPTII, BEPTII-I, TfR-lytic peptide, BPC96, RGD-Tachyplesin, MG2A, A9K, ERα17p, CR1166, and peptide aptamers, and Pep 2 and Pep3, and BIM SAHBA.

In one embodiment, the lytic peptide molecule inhibits angiogenesis. Examples of such lytic peptide molecules include, but are not limited to, Pentastatin-1, chemokinostatin-1, and properdistatin.

In one embodiment, the lytic peptide molecule promotes ROS generation and DNA damage. Examples of such a lytic peptide molecules include A-8R.

In one embodiment, the lytic peptide molecule inhibits DNA synthesis. Examples of such lytic peptide molecules include, but are not limited to, Myristoyl-Cys-Ala-Val-Ala-Tyr-(1,3 dimethyl)His-OMe and 9 somatostatin peptide analogues.

In one embodiment, the lytic peptide is immune modulatory. Examples of such lytic peptide molecules include, but are not limited to Alloferon-1 and Alloferon-2.

In one embodiment, the lytic peptide is LTX-401.

In one embodiment the lytic peptide is a citropin, a gaegurin, a asioglossin, cylotides, hCAP-18, NK-2, Buforin IIb, CB1a, melittin, Temporin L, Temporin-1DRalpha, BMAP-27, BMAP 28, or LL-37. In one embodiment the lytic peptide is a cylotide. Cylotides include but are not limited to Cycloviolacin O2, Vary A and vary F, vary E, and vitri A, Vibi D, vibi E, vibi G, and vibi H, Psyle A to psyle F, and MCoCC-1 and MCoCC-2. In some embodiments, the lytic peptides are ChBac3.4, PR-39, or Indolicidin.

The lytic peptides may be toxic to cancer cells only or in some cases have toxicity to cancer and non cancer cells. In some embodiments, the lytic peptides are alpha-Helical anticancer peptides. In some embodiments the a-Helical peptides are toxic to cancer cells only. In some embodiments, alpha-helical peptides are toxic to cancer and non-cancer cells. In some embodiments, the lytic peptides are beta-Sheet anticancer peptides. In some embodiments, the b-Sheet peptides are toxic to cancer cells only. In some embodiments, the beta-Sheet peptides are toxic to cancer and non cancer cells. In some embodiments the peptides are extended structure anticancer peptides, which can be either toxic to cancer cells only or to cancer and non-cancerous cells.

In some embodiments, the lytic peptide encoded by the genetically engineered bacteria or genetically engineered virus is selected from any of the peptides listed in the Tables 22-24 below. Examples of Lytic Peptide sequences are provided in Table 23. Additional peptide sequences are provided in Table 24.

TABLE 22

Oncolytic peptides with membrane disruption/lysis/pore formation activity

D-peptides A, B, C, D
NRC-3, NRC-07
Polybia-MPI
Hepcidin TH2-3
SVS-1
Epinecidin-1
Temporin-1CEa
Polycationic peptides
SK84
Magainin analogues (i.e. Magainin 2)
Cecropin CB1

TABLE 22-continued

Oncolytic peptides with membrane disruption/lysis/pore formation activity

Cecropin A, Cecropin B
Melittin
BMAP-27, BMAP-28
Lactoferricin B and B6
Clyotides
HPN-1, HNP-2, HNP-3
Tachyplesin 1
Gomesin
LL-37

TABLE 23

Lytic Peptide Sequences

| Peptide | Sequences | References |
| --- | --- | --- |
| D-peptide A SEQ ID NO: 126 | RLYLRIGRR | Iwasaki et al., 2009 |
| D-peptide B SEQ ID NO: 127 | RLRLRIGRR | |
| D-peptide C SEQ ID NO: 128 | ALYLAIRRR | |
| D-peptide D SEQ ID NO: 129 | RLLLRIGRR | |
| D-K6L9 SEQ ID NO: 130 | LKLLKKLLKKLLKLL | Papo et al., 2006 |
| NRC-03 SEQ ID NO: 131 | GRRKRKWLRRIGKGVKIIGGAALDHL | Hilchie et al., 2011 |
| NRC-07 SEQ ID NO: 132 | RWGKWFKKATHVGKHVGKAALTAYL | |
| Gomesin SEQ ID NO: 133 | ZCRRLCYKQRCVTYCRGR | Rodrigues et al., 2008 |
| Hepcidin TH2-3 SEQ ID NO: 134 | QSHLSLCRWCCNCCRSNKGC | Chen et al., 2009 |
| Dermaseptin B2 SEQ ID NO: 135 | GLWSKIKEVGKEAAKAAAKAAGKAALGAVSEAV | van Zoggel et al., 2012 |
| PTP7 SEQ ID NO: 136 | FLGALFKALSKLL | Kim et al., 2003 |
| MGA2 SEQ ID NO: 137 | GIGKFLHSAKKFGKAFVGEIMNSGGKKWKMRRNQF-WVKVQRG | Liu et al., 2013 |
| HNP-1 SEQ ID NO: 138 | ACYCRIPACIAGERRYGTCIYQGRLWAFCC | Wang et al., 2009 |
| Tachyplesin SEQ ID NO: 139 | KWCFRVCYRGICYRRCR | Chen et al., 2005 |

TABLE 23-continued

Lytic Peptide Sequences

| Peptide | Sequences | References |
|---|---|---|
| Temporin-1CEa SEQ ID NO: 140 | FVDLKKIANIINSIF | Wang et al., 2012 |
| NK-2 SEQ ID NO: 141 | KILRGVCKKIMRTFLRRISKDILTGKK | Schroder-Borm et al., 2005 |
| Bovine lactoferricin B6 (Lbcin B6) SEQ ID NO: 142 | RRWQWR | Richardson et al., 2009 |
| Cecropin CB1 SEQ ID NO: 143 | KWKVFKKIEKMGRNIRNGIVKAGPKWKVFKKIEK | Srisailam et al., 2000 |

TABLE 24

Peptide sequences

| Peptide | Sequence |
|---|---|
| Melittin SEQ ID NO: 144 | GIGAVLKVLTTGLPALISWIKRKRQQ |
| Tachyplesin SEQ ID NO: 145 | KWC1FRVC2YRGIC2YRRC1R |
| LL-37 SEQ ID NO: 146 | LLGDFFRKSKEKIGKEFKRIVQRIKDFLRNLVPRTES |
| Cecropin B SEQ ID NO: 147 | KWKVFKKIEKMGRNIRNGIVKAGPAIAVLGEAKAL |
| Magainin 2 SEQ ID NO: 148 | GIGKFLHSAKKFGKAFVGEIMNS |
| Buforin IIb SEQ ID NO: 149 | RAGLQFPVGRLLRRLLRRLLR |
| Alloferon-1 SEQ ID NO: 150 | HGVSGHGOHGVHG |
| Alloferon-2 SEQ ID NO: 151 | GVSGHGQHGVHG |

In some embodiments, the sequence is at least about 80%, at least about 85%, at least about 90%, at least about 95%, or at least about 99% homologous to the sequence of SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, and/or SEQ ID NO:151.

Activation of Effector Immune Cells (Immune Stimulators)

T-Cell Activators

Cytokines and Cytokine Receptors

CD4 (cluster of differentiation 4) is a glycoprotein found on the surface of immune cells such as T helper cells, monocytes, macrophages, and dendritic cells. CD4+T helper cells are white blood cells that function to send signals to other types of immune cells, thereby assisting other immune cells in immunologic processes, including maturation of B cells into plasma cells and memory B cells, and activation of cytotoxic T cells and macrophages. T helper cells become activated when they are presented with peptide antigens by MHC class II molecules, which are expressed on the surface of antigen-presenting cells (APCs). Once activated, T helper cells divide and secrete cytokines that regulate or assist in the active immune response. T helper cells can differentiate into one of several subtypes, including TH1, TH2, TH3, TH17, TH9, or TFH cells, which secrete different cytokines to facilitate different types of immune responses.

Cytotoxic T cells (TC cells, or CTLs) destroy virus-infected cells and tumor cells, and are also implicated in transplant rejection. These cells are also known as CD8+ T cells since they express the CD8 glycoprotein at their surfaces. Cytotoxic Tcells recognize their targets by binding to antigen associated with MHC class I molecules, which are present on the surface of all nucleated cells.

In some embodiments, the genetically engineered microorganisms, e.g., genetically engineered bacteria or genetically engineered oncolytic viruses, are capable of producing one or more anti-cancer molecules that modulates one or more T effector cells, e.g., CD4+ cell and/or CD8+ cell. In some embodiments, the genetically engineered bacteria or genetically engineered oncolytic viruses are capable of producing one or more anti-cancer molecules that activate, stimulate, and/or induce the differentiation of one or more T effector cells, e.g., CD4+ and/or CD8+ cells. In some embodiments, the immune modulator is a cytokine that activates, stimulates, and/or induces the differentiation of a T effector cell, e.g., CD4+ and/or CD8+ cells. In some embodiments, the genetically engineered bacteria or genetically engineered oncolytic viruses produce one or more cytokines selected from IL-2, IL-15, IL-12, IL-7, IL-21, IL-18, TNF, and interferon gamma (IFN-gamma). As used herein, the production of one or more cytokines includes fusion proteins which comprise one or more cytokines, which are fused through a peptide linked to another cytokine or other immune modulatory molecule. Examples include but are not limited to IL-12 and IL-15 fusion proteins. In general, all agonists and antagonists described herein may be fused to another polypeptide of interest through a peptide linker, to improve or alter their function. For example, in some embodiments, the genetically engineered bacteria or genetically engineered oncolytic viruses comprise sequence (s) encoding one or more cytokines selected from IL-2, IL-15, IL-12, IL-7, IL-21, IL-18, TNF, and IFN-gamma. In some embodiments, the genetically engineered microorganisms encode one or more cytokine fusion proteins. Non-limiting examples of such fusion proteins include one or more cytokine polypeptides operably linked to an antibody polypeptide, wherein the antibody recognizes a tumor-specific antigen, thereby bringing the cytokine(s) into proximity with the tumor.

Interleukin 12 (IL-12) is a cytokine, the actions of which create an interconnection between the innate and adaptive immunity. IL-12 is secreted by a number of immune cells, including activated dendritic cells, monocytes, macrophages, and neutrophils, as well as other cell types. IL-12 is a heterodimeric protein (IL-12-p'70; IL-12-p35/p40) consisting of p35 and p40 subunits, and binds to a receptor composed of two subunits, IL-12R-β1 and IL-12R-β2. IL-12 receptor is expressed constitutively or inducibly on a number of immune cells, including NK cells, T, and B lymphocytes. Upon binding of IL-12, the receptor is activated and downstream signaling through the JAK/STAT pathway initiated, resulting in the cellular response to IL-12. IL-12 acts by increasing the production of IFN-γ, which is the most potent mediator of IL-12 actions, from NK and T cells. In addition, IL-12 promotes growth and cytotoxicity of activated NK cells, CD8+ and CD4+ T cells, and shifts the differentiation of CD4+Th0 cells toward the Th1 phenotype. Further, IL-12 enhances of antibody-dependent cellular cytotoxicity (ADCC) against tumor cells and the induction of IgG and suppression of IgE production from B cells. In addition, IL-12 also plays a role in reprogramming of myeloid-derived suppressor cells, directs directs the Th1-type immune response and helps increase expression of MHC class I molecules (e.g., reviewed in Waldmann et al., *Cancer Immunol Res March* 2015 3; 219).

Thus, in some embodiments, the engineered bacteria or engineered oncolytic virus is engineered to produce IL-12. In some embodiments, the engineered bacteria or engineered oncolytic virus comprises sequence to encode IL-12. In some embodiments, the engineered bacteria or engineered oncolytic virus is engineered to over-express IL-12, for example, operatively linked to a strong promoter and/or comprising more than one copy of the IL-12 gene sequence. In some embodiments, the engineered bacteria or engineered oncolytic virus comprises sequence(s) encoding two or more copies of IL-12, e.g., two, three, four, five, six or more copies of IL-12 gene. In some embodiments, the engineered bacteria or engineered oncolytic virus produce one or more anti-cancer molecules that stimulate the production of IL-12. In some embodiments, the engineered bacteria or engineered oncolytic virus comprises sequence to encode IL-12 and sequence to encode a secretory peptide(s) for the secretion of IL-12. In any of these embodiments, the genetically engineered bacteria or genetically engineered oncolytic viruses is a tumor-targeting bacterium or tumor-targeting oncolytic virus. In some embodiments, the genetically engineered bacterium or genetically engineered oncolytic virus expresses IL-12 and/or expresses secretory peptides under the control of a promoter that is activated by low-oxygen conditions. In some embodiments, the genetically engineered bacterium or genetically engineered oncolytic virus is a tumor-targeting bacterium or tumor-targeting oncolytic virus that expresses IL-12, and/or expresses secretory peptide(s) under the control of a promoter that is activated by low-oxygen conditions. In certain embodiments, the genetically engineered bacteria or genetically engineered oncolytic viruses express L-12 and/or secretory peptide(s), under the control of a promoter that is activated by hypoxic conditions, or by inflammatory conditions, such as any of the promoters activated by said conditions and described herein. In some embodiments, the genetically engineered bacteria or genetically engineered OV expresses IL-12 and/or expresses secretory peptide(s), under the control of a cancer-specific promoter, a tissue-specific promoter, or a constitutive promoter, such as any of the promoters described herein.

IL-15 displays pleiotropic functions in homeostasis of both innate and adaptive immune system and binds to IL-15 receptor, a heterotrimeric receptor composed of three subunits. The alpha subunit is specific for IL-15, while beta (CD122) and gamma (CD132) subunits are shared with the IL-2 receptor, and allow shared signaling through the JAJ/STAT pathways.

IL-15 is produced by several cell types, including dendritic cells, monocytes and macrophages. Co-expression of IL-15Rα and IL-15 produced in the same cell, allows intracellular binding of IL-15 to IL-15Rα, which is then shuttled to the cell surface as a complex. Once on the cell surface, then, the IL-15Rα of these cells is able to trans-present IL-15 to IL-15Rβ-γc of CD8 T cells, NK cells, and NK-T cells, which do not express IL-15, inducing the formation of the so-called immunological synapse. Murine and human IL-15Rα, exists both in membrane bound, and also in a soluble form. Soluble IL-15Rα (sIL-15Rα) is constitutively generated from the transmembrane receptor through proteolytic cleavage.

IL-15 is critical for lymphoid development and peripheral maintenance of innate immune cells and immunological memory of T cells, in particular natural killer (NK) and CD8+ T cell populations. In contrast to IL-2, IL-15 does not promote the maintenance of Tregs and furthermore, IL-15 has been shown to protect effector T cells from IL-2-mediated activation-induced cell death.

Consequently, delivery of IL-15 is considered a promising strategy for long-term anti-tumor immunity. In a first-in-human clinical trial of recombinant human IL-15, a 10-fold expansion of NK cells and significantly increased the proliferation of γδT cells and CD8+ T cells was observed upon treatment. In addition, IL-15 superagonists containing cytokine-receptor fusion complexes have been developed and are evaluated to increate the length of the response. These include the L-15 N72D superagonist/IL-15RαSushi-Fc fusion complex (IL-15SA/IL-15RαSu-Fc; ALT-803) (Kim et al., 2016 IL-15 superagonist/IL-15RαSushi-Fc fusion complex (IL-15SA/IL-15RαSu-Fc; ALT-803) markedly enhances specific subpopulations of NK and memory CD8+ T cells, and mediates potent anti-tumor activity against murine breast and colon carcinomas).

Thus, in some embodiments, the engineered bacteria or engineered oncolytic virus is engineered to produce IL-15. In some embodiments, the engineered bacteria or engineered oncolytic virus comprises sequence to encode IL-15. In some embodiments, the engineered bacteria or engineered oncolytic virus is engineered to over-express IL-15, for example, operatively linked to a strong promoter and/or comprising more than one copy of the IL-15 gene sequence.

In some embodiments, the engineered bacteria or engineered oncolytic virus comprises sequence(s) encoding two or more copies of IL-15 gene, e.g., two, three, four, five, six or more copies of IL-15 gene. In some embodiments, the engineered bacteria or engineered oncolytic virus produce one or more anti-cancer molecules that stimulate the production of IL-15. In some embodiments, the engineered bacteria or engineered oncolytic virus comprises sequence to encode IL-15Ra. In some embodiments, the engineered bacteria or engineered oncolytic virus comprises sequence to encode IL-15 and sequence to encode IL-15Ra. In some embodiments, the engineered bacteria or engineered oncolytic virus comprises sequence to encode a fusion polypeptide comprising IL-15 and IL-15Ra. In some embodiments, the engineered bacteria or engineered oncolytic virus comprises sequence(s) to encode IL-15 and sequence to encode a secretory peptide(s) for the secretion of IL-15. In any of these embodiments, the genetically engineered bacteria or genetically engineered oncolytic viruses is a tumor-targeting bacterium or tumor-targeting oncolytic virus. In some embodiments, the genetically engineered bacterium or genetically engineered oncolytic virus expresses IL-15 and/or expresses secretory peptides under the control of a promoter that is activated by low-oxygen conditions. In some embodiments, the genetically engineered bacterium or genetically engineered oncolytic virus is a tumor-targeting bacterium or tumor-targeting oncolytic virus that expresses IL-15, and/or expresses secretory peptide(s) under the control of a promoter that is activated by low-oxygen conditions. In certain embodiments, the genetically engineered bacteria or genetically engineered oncolytic viruses express IL-15 and/or secretory peptide(s), under the control of a promoter that is activated by hypoxic conditions, or by inflammatory conditions, such as any of the promoters activated by said conditions and described herein. In some embodiments, the genetically engineered bacteria or genetically engineered OV expresses IL-15 and/or expresses secretory peptide(s), under the control of a cancer-specific promoter, a tissue-specific promoter, or a constitutive promoter, such as any of the promoters described herein.

Interferon gamma (IFNγ or type II interferon), is a cytokine that is critical for innate and adaptive immunity against viral, some bacterial and protozoal infections. IFNγ activates macrophages and induces Class II major histocompatibility complex (MHC) molecule expression. IFNγ can inhibit viral replication and has immunostimulatory and immunomodulatory effects in the immune system. IFNγ is produced predominantly by natural killer (NK) and natural killer T (NKT) cells as part of the innate immune response, and by CD4 Th1 and CD8 cytotoxic T lymphocyte (CTL) effector T cells. Once antigen-specific immunity develops IFNγ is secreted by T helper cells (specifically, $T_h1$ cells), cytotoxic T cells ($T_C$ cells) and NK cells only. Its has numerous imunostimulatory effects and plays several different roles in the immune system, including the promotion of NK cell activity, increased antigen presentation and lysosome activity of macrophages, activation of inducible Nitric Oxide Synthase iNOS, production of certain IgGs from activated plasma B cells, promotion of $T_h1$ differentiation that leads to cellular immunity. It can also cause normal cells to increase expression of class I MHC molecules as well as class II MHC on antigen-presenting cells, promote adhesion and binding relating to leukocyte migration, and is involved in granuloma formation through the activation of macrophages so that they become more powerful in killing intracellular organisms.

Thus, in some embodiments, the engineered bacteria or engineered oncolytic virus is engineered to produce IFN-γ. In some embodiments, the engineered bacteria or engineered oncolytic virus comprises sequence to encode IFN-γ. In some embodiments, the engineered bacteria or engineered oncolytic virus is engineered to over-express IFN-γ, for example, operatively linked to a strong promoter and/or comprising more than one copy of the IFN-γ gene sequence. In some embodiments, the engineered bacteria or engineered oncolytic virus comprises sequence(s) encoding two or more copies of IFN-γ gene, e.g., two, three, four, five, six or more copies of IFN-γ gene. In any of these embodiments, the genetically engineered bacteria or genetically engineered oncolytic viruses is a tumor-targeting bacterium or tumor-targeting oncolytic virus. In some embodiments, the genetically engineered bacterium or genetically engineered oncolytic virus expresses IFN-γ and/or expresses secretory peptides under the control of a promoter that is activated by low-oxygen conditions. In some embodiments, the genetically engineered bacterium or genetically engineered oncolytic virus is a tumor-targeting bacterium or tumor-targeting oncolytic virus that expresses IFN-γ, and/or expresses secretory peptide(s) under the control of a promoter that is activated by low-oxygen conditions. In certain embodiments, the genetically engineered bacteria or genetically engineered oncolytic viruses express IFN-γ and/or secretory peptide(s), under the control of a promoter that is activated by hypoxic conditions, or by inflammatory conditions, such as any of the promoters activated by said conditions and described herein. In some embodiments, the genetically engineered bacteria or genetically engineered OV expresses IFN-γ and/or expresses secretory peptide(s), under the control of a cancer-specific promoter, a tissue-specific promoter, or a constitutive promoter, such as any of the promoters described herein.

Interleukin-18 (IL18, also known as interferon-gamma inducing factor) is a proinflammatory cytokine that belongs to the IL-1 superfamily and is produced by macrophages and other cells. IL-18 binds to the interleukin-18 receptor, and together with IL-12 it induces cell-mediated immunity following infection with microbial products like lipopolysaccharide (LPS). Upon stimulation with IL-18, natural killer (NK) cells and certain Thelper type 1 cells release interferon-γ (IFN-γ) or type II interferon, which plays a role in activating the macrophages and other immune cells. IL-18 is also able to induce severe inflammatory reactions.

Thus, in some embodiments, the engineered bacteria or engineered oncolytic virus is engineered to produce IL-18. In some embodiments, the engineered bacteria or engineered oncolytic virus comprises sequence to encode IL-18. In some embodiments, the engineered bacteria or engineered oncolytic virus is engineered to over-express IL-18, for example, operatively linked to a strong promoter and/or comprising more than one copy of the IL-18 gene sequence. In some embodiments, the engineered bacteria or engineered oncolytic virus comprises sequence(s) encoding two or more copies of IL-18 gene, e.g., two, three, four, five, six or more copies of IL-18 gene. In any of these embodiments, the genetically engineered bacteria or genetically engineered oncolytic viruses is a tumor-targeting bacterium or tumor-targeting oncolytic virus. In some embodiments, the genetically engineered bacterium or genetically engineered oncolytic virus expresses IL-18 and/or expresses secretory peptides under the control of a promoter that is activated by low-oxygen conditions. In some embodiments, the genetically engineered bacterium or genetically engineered oncolytic virus is a tumor-targeting bacterium or tumor-targeting oncolytic virus that expresses IL-18, and/or expresses secretory peptide(s) under the control of a promoter that is activated by low-oxygen conditions. In certain embodiments, the genetically engineered bacteria or genetically engineered oncolytic viruses express IL-18 and/or secretory peptide(s), under the control of a promoter that is activated by hypoxic conditions, or by inflammatory conditions, such as any of the promoters activated by said conditions and described herein. In some embodiments, the genetically engineered bacteria or genetically engineered OV expresses IL-18 and/or expresses secretory peptide(s), under the control of a cancer-specific promoter, a tissue-specific promoter, or a constitutive promoter, such as any of the promoters described herein.

Interleukin-2 (IL-2) is cytokine that regulates the activities of white blood cells (leukocytes, often lymphocytes). IL-2 is part of the body's natural response to microbial infection, and in discriminating between foreign ("non-self") and "self". IL-2 mediates its effects by binding to IL-2 receptors, which are expressed by lymphocytes. IL-2 is a member of a cytokine family, which also includes IL-4, IL-7, IL-9, IL-15 and IL-21. IL-2 signals through the IL-2 receptor, a complex consisting of alpha, beta and gamma sub-units. The gamma sub-unit is shared by all members of this family of cytokine receptors. IL-2 promotes the differentiation of T cells into effector T cells and into memory T cells when the initial T cell is stimulated by an antigen. Through its role in the development of T cell immunologic memory, which depends upon the expansion of the number and function of antigen-selected T cell clones, it also has a key role in cell-mediated immunity. IL-2 has been approved by the Food and Drug Administration (FDA) and in several European countries for the treatment of cancers (malignant melanoma, renal cell cancer). IL-2 is also used to treat melanoma metastases and has a high complete response rate.

Thus, in some embodiments, the engineered bacteria or engineered oncolytic virus is engineered to produce IL-2. In some embodiments, the engineered bacteria or engineered oncolytic virus comprises sequence to encode IL-2. In some embodiments, the engineered bacteria or engineered oncolytic virus is engineered to over-express IL-2, for example, operatively linked to a strong promoter and/or comprising more than one copy of the IL-2 gene sequence. In some embodiments, the engineered bacteria or engineered oncolytic virus comprises sequence(s) encoding two or more copies of IL-2 gene, e.g., two, three, four, five, six or more copies of IL-2 gene. In any of these embodiments, the genetically engineered bacteria or genetically engineered oncolytic viruses is a tumor-targeting bacterium or tumor-targeting oncolytic virus. In some embodiments, the genetically engineered bacterium or genetically engineered oncolytic virus expresses IL-2 and/or expresses secretory peptides under the control of a promoter that is activated by low-oxygen conditions. In some embodiments, the genetically engineered bacterium or genetically engineered oncolytic virus is a tumor-targeting bacterium or tumor-targeting oncolytic virus that expresses IL-2, and/or expresses secretory peptide(s) under the control of a promoter that is activated by low-oxygen conditions. In certain embodiments, the genetically engineered bacteria or genetically engineered oncolytic viruses express IL-2 and/or secretory peptide(s), under the control of a promoter that is activated by hypoxic conditions, or by inflammatory conditions, such as any of the promoters activated by said conditions and described herein. In some embodiments, the genetically engineered bacteria or genetically engineered OV expresses IL-2 and/or expresses secretory peptide(s), under the control of a cancer-specific promoter, a tissue-specific promoter, or a constitutive promoter, such as any of the promoters described herein.

Interleukin-21 is a cytokine that has potent regulatory effects on certain cells of the immune system, including natural killer (NK) cells and cytotoxic T cells. IL-21 induces cell division/proliferation in its these cells. IL-21 is expressed in activated human CD4+ T cells but not in most other tissues. In addition, IL-21 expression is up-regulated in $T_h2$ and $T_h17$ subsets of T helper cells. IL-21 is also expressed in NK T cells regulating the function of these cells. When bound to IL-21, the IL-21 receptor acts through the Jak/STAT pathway, utilizing Jak1 and Jak3 and a STAT3 homodimer to activate its target genes. IL-21 has been shown to modulate the differentiation programming of human T cells by enriching for a population of memory-type CTL with a unique CD28+ CD127hi CD45RO+ phenotype with IL-2 producing capacity. IL-21 also has anti-tumour effects through continued and increased CD8+ cell response to achieve enduring tumor immunity. IL-21 has been approved for Phase 1 clinical trials in metastatic melanoma (MM) and renal cell carcinoma (RCC) patients.

Thus, in some embodiments, the engineered bacteria or engineered oncolytic virus is engineered to produce IL-21. In some embodiments, the engineered bacteria or engineered oncolytic virus comprises sequence that encodes IL-21. In some embodiments, the engineered bacteria or engineered oncolytic virus is engineered to over-express IL-21, for example, operatively linked to a strong promoter and/or comprising more than one copy of the IL-21 gene sequence. In some embodiments, the engineered bacteria or engineered oncolytic virus comprises sequence(s) encoding two or more copies of IL-21, e.g., two, three, four, five, six or more copies of IL-21 gene. In some embodiments, the engineered bacteria or engineered oncolytic virus produce one or more anti-cancer molecules that stimulate the production of IL-21. In some embodiments, the engineered bacteria or engineered oncolytic virus comprises sequence to encode IL-21 and sequence to encode a secretory peptide(s) for the secretion of Il-21. In any of these embodiments, the genetically engineered bacteria or genetically engineered oncolytic viruses is a tumor-targeting bacterium or tumor-targeting oncolytic virus. In some embodiments, the genetically engineered bacterium or genetically engineered oncolytic virus expresses IL-21 and/or expresses secretory peptides under the control of a promoter that is activated by low-oxygen conditions. In some embodiments, the genetically engineered bacterium or genetically engineered oncolytic virus is a tumor-targeting bacterium or tumor-targeting oncolytic virus that expresses Il-21, and/or expresses secretory peptide(s) under the control of a promoter that is activated by low-oxygen conditions. In certain embodiments, the genetically engineered bacteria or genetically engineered oncolytic viruses expresses IL-21 and/or secretory peptide(s), under the control of a promoter that is activated by hypoxic conditions, or by inflammatory conditions, such as any of the promoters activated by said conditions and described herein. In some embodiments, the genetically engineered bacteria or genetically engineered OV expresses IL-21 and/or expresses secretory peptide(s), under the control of a cancer-specific promoter, a tissue-specific promoter, or a constitutive promoter, such as any of the promoters described herein.

Tumor necrosis factor (TNF) (also known as cachectin or TNF alpha) is a cytokine that can cause cytolysis of certain tumor cell lines and can stimulate cell proliferation and induce cell differentiation under certain conditions. TNF is involved in systemic inflammation and is one of the cytokines that make up the acute phase reaction. It is produced chiefly by activated macrophages, although it can be produced by many other cell types such as CD4+ lymphocytes, NK cells, neutrophils, mast cells, eosinophils, and neurons. The primary role of TNF is in the regulation of immune cells.

TNF can bind two receptors, TNFR1 (TNF receptor type 1; CD120a; p55/60) and TNFR2 (TNF receptor type 2; CD120b; p75/80). TNFR1 is expressed in most tissues, and can be fully activated by both the membrane-bound and soluble trimeric forms of TNF, whereas TNFR2 is found only in cells of the immune system, and respond to the membrane-bound form of the TNF homotrimer. Upon binding to its receptor, TNF can activate NF-κB and MAPK pathways which mediate the transcription of numerous proteins and mediate several pathways involved in cell differentiation and proliferation, including those pathways involved in the inflammatory response. TNF also regulates pathways that induce cell apoptosis.

In some embodiments, the genetically engineered bacteria are capable of producing an immune modulator that modulates dendritic cell activation. In some embodiments, the immune modulator is TNF. Thus, in some embodiments, the engineered bacteria or engineered oncolytic virus is engineered to produce TNF. In some embodiments, the engineered bacteria or engineered oncolytic virus comprises sequence that encodes TNF. In some embodiments, the engineered bacteria or engineered oncolytic virus is engineered to over-express TNF, for example, operatively linked to a strong promoter and/or comprising more than one copy of the TNF gene sequence. In some embodiments, the engineered bacteria or engineered oncolytic virus comprises sequence(s) encoding two or more copies of TNF, e.g., two, three, four, five, six or more copies of TNF gene. In some embodiments, the engineered bacteria or engineered oncolytic virus produce one or more anti-cancer molecules that stimulate the production of TNF. In some embodiments, the engineered bacteria or engineered oncolytic virus comprises sequence to encode TNF and sequence to encode a secretory peptide(s) for the secretion of TNF. In any of these embodiments, the genetically engineered bacteria or genetically engineered oncolytic viruses is a tumor-targeting bacterium or tumor-targeting oncolytic virus. In some embodiments, the genetically engineered bacterium or genetically engineered oncolytic virus expresses TNF and/or expresses secretory peptides under the control of a promoter that is activated by low-oxygen conditions. In some embodiments, the genetically engineered bacterium or genetically engineered oncolytic virus is a tumor-targeting bacterium or tumor-targeting oncolytic virus that expresses TNF, and/or expresses secretory peptide(s) under the control of a promoter that is activated by low-oxygen conditions. In certain embodiments, the genetically engineered bacteria or genetically engineered oncolytic viruses express TNF and/or secretory peptide(s), under the control of a promoter that is activated by hypoxic conditions, or by inflammatory conditions, such as any of the promoters activated by said conditions and described herein. In some embodiments, the genetically engineered bacteria or genetically engineered OV expresses TNF and/or expresses secretory peptide(s), under the control of a cancer-specific promoter, a tissue-specific promoter, or a constitutive promoter, such as any of the promoters described herein.

Granulocyte-macrophage colony-stimulating factor (GM-CSF), also known as colony stimulating factor 2 (CSF2), is a monomeric glycoprotein secreted by macrophages, T cells, mast cells, NK cells, endothelial cells and fibroblasts. GM-CSF is a white blood cell growth factor that functions as a cytokine, facilitating the development of the immune system and promoting defense against infections. For example, GM-CSF stimulates stem cells to produce granulocytes (neutrophils, eosinophils, and basophils) and monocytes, which monocytes exit the circulation and migrate into tissue, whereupon they mature into macrophages and dendritic cells. GM-CSF is part of the immune/inflammatory cascade, by which activation of a small number of macrophages rapidlys lead to an increase in their numbers, a process which is crucial for fighting infection. GM-CSF signals via the signal transducer and activator of transcription, STAT5 or via STAT3 (which activates macrophages).

In some embodiments, the genetically engineered bacteria are capable of producing an immune modulator that modulates dendritic cell activation. In some embodiments, the immune modulator is GM-CSF. Thus, in some embodiments, the engineered bacteria or engineered oncolytic virus is engineered to produce GM-CSF. In some embodiments, the engineered bacteria or engineered oncolytic virus comprises sequence that encodes GM-CSF. In some embodiments, the engineered bacteria or engineered oncolytic virus is engineered to over-express GM-CSF, for example, operatively linked to a strong promoter and/or comprising more than one copy of the GM-CSF gene sequence. In some embodiments, the engineered bacteria or engineered oncolytic virus comprises sequence(s) encoding two or more copies of GM-CSF, e.g., two, three, four, five, six or more copies of GM-CSF gene. In some embodiments, the engineered bacteria or engineered oncolytic virus produce one or more anti-cancer molecules that stimulate the production of GM-CSF. In some embodiments, the engineered bacteria or engineered oncolytic virus comprises sequence to encode GM-CSF and sequence to encode a secretory peptide(s) for the secretion of GM-CSF. In any of these embodiments, the genetically engineered bacteria or genetically engineered oncolytic viruses is a tumor-targeting bacterium or tumor-targeting oncolytic virus. In some embodiments, the genetically engineered bacterium or genetically engineered oncolytic virus expresses GM-CSF and/or expresses secretory peptides under the control of a promoter that is activated by low-oxygen conditions. In some embodiments, the genetically engineered bacterium or genetically engineered oncolytic virus is a tumor-targeting bacterium or tumor-targeting oncolytic virus that expresses GM-CSF, and/or expresses secretory peptide(s) under the control of a promoter that is activated by low-oxygen conditions. In certain embodiments, the genetically engineered bacteria or genetically engineered oncolytic viruses express GM-CSF and/or secretory peptide(s), under the control of a promoter that is activated by hypoxic conditions, or by inflammatory conditions, such as any of the promoters activated by said conditions and described herein. In some embodiments, the genetically engineered bacteria or genetically engineered OV expresses GM-CSF and/or expresses secretory peptide(s), under the control of a cancer-specific promoter, a tissue-specific promoter, or a constitutive promoter, such as any of the promoters described herein.

TABLE 27

| Name | NP/GI Nos. | Notes | Sequences |
|---|---|---|---|
| interleukin-12 subunit alpha precursor (homo sapiens) SEQ ID NO: 152 | NP_000873.2/ GI: 24430219 | Signal peptide: 1-56; Mature protein: 57-253 | MWPPGSASQPPPSPAAATGLHPAARP VSLQCRLSMCPARSLLLVATLVLLDHLSL ARNLPVATPDPGMFPCLHHSQNLLRAV SNMLQKARQTLEFYPCTSEEIDHEDITKD KTSTVEACLPLELTKNESCLNSRETSFITN GSCLASRKTSFMMALCLSSIYEDLKMYQ VEFKTMNAKLLMDPKRQIFLDQNMLAV IDELMQALNFNSETVPQKSSLEEPDFYKT KIKLCILLHAFRIRAVTIDRVMSYLNAS |
| interleukin-12 subunit beta precursor (homo sapiens) SEQ ID NO: 153 | NP_002178.2/ GI: 24497438 | Signal peptide: 1-22; Mature Peptide: 23-328 | MCHQQLVISWFSLVFLASPLVAIWELKK DVYVVELDWYPDAPGEMVVLTCDTPEE DGITWTLDQSSEVLGSGKTLTIQVKEFG DAGQYTCHKGGEVLSHSLLLLHKKEDGI WSTDILKDQKEPKNKTFLRCEAKNYSGR FTCWWLTTISTDLTFSVKSSRGSSDPQG VTCGAATLSAERVRGDNKEYEYSVECQE DSACPAAEESLPIEVMVDAVHKLKYENY TSSFFIRDIIKPDPPKNLQLKPLKNSRQVE VSWEYPDTWSTPHSYFSLTFCVQVQGK SKREKKDRVFTDKTSATVICRKNASISVR AQDRYYSSSWSEWASVPCS |
| interleukin-15 isoform1 preproprotein (homo sapiens) SEQ ID NO: 154 | NP_000576.1/ GI: 10835153 | Signal peptide: 1-29; Proprotein: 30-162; Region: 33-160; mature peptide: 49..162 | MRISKPHLRSISIQCYLCLLLNSHFLTEAGI HVFILGCFSAGLPKTEANWVNVISDLKKI EDLIQSMHIDATLYTESDVHPSCKVTAM KCFLLELQVISLESGDASIHDTVENLIILAN NSLSSNGNVTESGCKECEELEEKNIKEFL QSFVHIVQMFINTS |
| interleukin-15 isoform 2 preproprotein (homo sapiens) SEQ ID NO: 155 | NP_751915.1/ GI: 26787986 | Protein: 1-135; Region: 6-133 | MVLGTIDLCSCFSAGLPKTEANWVNVIS DLKKIEDLIQSMHIDATLYTESDVHPSCK VTAMKCFLLELQVISLESGDASIHDTVEN LIILANNSLSSNGNVTESGCKECEELEEKN IKEFLQSFVHIVQMFINTS |
| interleukin-2 precursor (homo sapiens) SEQ ID NO: 156 | NP_000577.2/ GI: 28178861 | Signal peptide: 1-20; RegionL7-150 | MYRMQLLSCIALSLALVTNSAPTSSSTKK TQLQLEHLLLDLQMILNGINNYKNPKLT RMLTFKFYMPKKATELKHLQCLEEELKPL EEVLNLAQSKNFHLRPRDLISNINVIVLEL KGSETTFMCEYADETATIVEFLNRWITFC QSIISTLT |
| interleukin-21 isoform 1 precursor (homo sapiens) SEQ ID NO: 157 | NP_068575.1/ GI: 11141875 | Signal peptide: 1-29; Region: 42-148 | MRSSPGNMERIVICLMVIFLGTLVHKSSS QGQDRHMIRMRQLIDIVDQLKNYVNDL VPEFLPAPEDVETNCEWSAFSCFQKAQL KSANTGNNERIINVSIKKLKRKPPSTNAG RRQKHRLTCPSCDSYEKKPPKEFLERFKS LLQKMIHQHLSSRTHGSEDS |
| interleukin-21 isoform 2 precursor (homo sapiens) SEQ ID NO: 158 | NP_001193935.1/ GI: 333033767 | Signal peptide: 1-29; Region: 42-146 | MRSSPGNMERIVICLMVIFLGTLVHKSSS QGQDRHMIRMRQLIDIVDQLKNYVNDL VPEFLPAPEDVETNCEWSAFSCFQKAQL KSANTGNNERIINVSIKKLKRKPPSTNAG RRQKHRLTCPSCDSYEKKPPKEFLERFKS LLQKVSTLSFI |
| granulocyte-macrophage colony-stimulating factor precursor (homo sapiens) SEQ ID NO: 159 | NP_000749.2/ GI: 27437030 | Signal peptide: 1-17; Mature peptide: 18-144; Region: 18-138 | MWLQSLLLLGTVACSISAPARSPSPSTQ PWEHVNAIQEARRLLNLSRDTAAEMNE TVEVISEMFDLQEPTCLQTRLELYKQGLR GSLTKLKGPLTMMASHYKQHCPPTPETS CATQIITFESFKENLKDFLLVIPFDCWEPV QE |

In some embodiments, the promoter sequence is at least about 80%, at least about 85%, at least about 90%, at least about 95%, or at least about 99% homologous to the sequence of SEQ ID NO: 152, SEQ ID NO: 153, SEQ ID NO: 154, SEQ ID NO: 155, SEQ ID NO: 156, SEQ ID NO: 157, SEQ ID NO: 158, and/or SEQ ID NO: 159.

In some embodiments, certain prescusor sequences are replaced with one or more bacterial sequences, including but not limited to bacterial secretion signal sequences. In some embodiments the polynucleotide sequence encoding the cytokines are codon-optimized for bacterial expression.

In some embodiments, certain prescusor sequences are replaced with one or more mammalian sequences, including but not limited to mammalian secretion signal sequences. In some embodiments the polynucleotide sequence encoding the cytokines are codon-optimized for mammalian expression.

Co-stimulatory Molecules

CD40 is a costimulatory protein found on antigen presenting cells and is required for their activation. The binding of CD154 (CD40L) on T helper cells to CD40 activates antigen presenting cells and induces a variety of downstream immunostimulatory effects. In some embodiments, the anti-cancer molecule (e.g., immune modulator) is an agonist of CD40, for example, an agonist selected from an agonistic anti-CD40 antibody, agonistic anti-CD40 antibody fragment, CD40 ligand (CD40L) polypeptide, and CD40L polypeptide fragment. Thus, in some embodiments, the genetically engineered bacteria or genetically engineered oncolytic virus comprise sequence(s) encoding an agonistic anti-CD40 antibody, an agonistic anti-CD40 antibody fragment, a CD40 ligand (CD40L) polypeptide, or a CD40L polypeptide fragment.

Thus, in some embodiments, the engineered bacteria or engineered oncolytic virus is engineered to produce an agonistic anti-CD40 antibody, an agonistic anti-CD40 antibody fragment, a CD40 ligand (CD40L) polypeptide, or a CD40L polypeptide fragment. In some embodiments, the engineered bacteria or engineered oncolytic virus comprises sequence to encode an agonistic anti-CD40 antibody, an agonistic anti-CD40 antibody fragment, a CD40 ligand (CD40L) polypeptide, or a CD40L polypeptide fragment. In some embodiments, the engineered bacteria or engineered oncolytic virus is engineered to over-express an agonistic anti-CD40 antibody, an agonistic anti-CD40 antibody fragment, a CD40 ligand (CD40L) polypeptide, or a CD40L polypeptide fragment, for example, operatively linked to a strong promoter and/or comprising more than one copy of any of these gene sequences. In some embodiments, the engineered bacteria or engineered oncolytic virus comprises sequence(s) encoding two or more copies of an agonistic anti-CD40 antibody, an agonistic anti-CD40 antibody fragment, a CD40 ligand (CD40L) polypeptide, or a CD40L polypeptide fragment, e.g., two, three, four, five, six or more copies of any of these sequences. In some embodiments, the engineered bacteria or engineered oncolytic virus comprises sequence(s) to encode an agonistic anti-CD40 antibody, an agonistic anti-CD40 antibody fragment, a CD40 ligand (CD40L) polypeptide, or a CD40L polypeptide fragment and sequence to encode a secretory peptide(s) for the secretion of said antibodies and polypeptides. In any of these embodiments, the genetically engineered bacteria or genetically engineered oncolytic viruses is a tumor-targeting bacterium or tumor-targeting oncolytic virus. In some embodiments, the genetically engineered bacterium or genetically engineered oncolytic virus expresses an agonistic anti-CD40 antibody, an agonistic anti-CD40 antibody fragment, a CD40 ligand (CD40L) polypeptide, or a CD40L polypeptide fragment and/or expresses secretory peptide(s) under the control of a promoter that is activated by low-oxygen conditions. In some embodiments, the genetically engineered bacterium or genetically engineered oncolytic virus is a tumor-targeting bacterium or tumor-targeting oncolytic virus that expresses an agonistic anti-CD40 antibody, an agonistic anti-CD40 antibody fragment, a CD40 ligand (CD40L) polypeptide, or a CD40L polypeptide fragment and/or expresses secretory peptide(s) under the control of a promoter that is activated by low-oxygen conditions. In certain embodiments, the genetically engineered bacteria or genetically engineered oncolytic viruses express an agonistic anti-CD40 antibody, an agonistic anti-CD40 antibody fragment, a CD40 ligand (CD40L) polypeptide, or a CD40L polypeptide fragment and/or secretory peptide(s), under the control of a promoter that is activated by hypoxic conditions, or by inflammatory conditions, such as any of the promoters activated by said conditions and described herein. In some embodiments, the genetically engineered bacteria or genetically engineered OV expresses an agonistic anti-CD40 antibody, an agonistic anti-CD40 antibody fragment, a CD40 ligand (CD40L) polypeptide, or a CD40L polypeptide fragment and/or expresses secretory peptide(s), under the control of a cancer-specific promoter, a tissue-specific promoter, or a constitutive promoter, such as any of the promoters described herein.

CD28 is one of the proteins expressed on T cells that provide co-stimulatory signals required for T cell activation and survival. In some embodiments, the anti-cancer molecule (e.g., immune modulator) is an agonist of CD28, for example, an agonist selected from agonistic anti-CD28 antibody, agonistic anti-CD28 antibody fragment, CD80 (B7.1) polypeptide or polypeptide fragment thereof, and CD86 (B7.2) polypeptide or polypeptide fragment thereof. Thus, in some embodiments, the genetically engineered bacteria or genetically engineered oncolytic virus comprise sequence(s) encoding an agonistic anti-CD28 antibody, an agonistic anti-CD28 antibody fragment, a CD80 polypeptide, a CD80 polypeptide fragment, a CD86 polypeptide or a CD86 polypeptide fragment. In some embodiments, the engineered bacteria or engineered oncolytic virus is engineered to produce an agonistic anti-CD28 antibody, an agonistic anti-CD28 antibody fragment, a CD80 polypeptide, a CD80 polypeptide fragment, a CD86 polypeptide or a CD86 polypeptide fragment. In some embodiments, the engineered bacteria or engineered oncolytic virus comprises sequence to encode an agonistic anti-CD28 antibody, an agonistic anti-CD28 antibody fragment, a CD80 polypeptide, a CD80 polypeptide fragment, a CD86 polypeptide or a CD86 polypeptide fragment. In some embodiments, the engineered bacteria or engineered oncolytic virus is engineered to over-express an agonistic anti-CD28 antibody, an agonistic anti-CD28 antibody fragment, a CD80 polypeptide, a CD80 polypeptide fragment, a CD86 polypeptide or a CD86 polypeptide fragment, for example, operatively linked to a strong promoter and/or comprising more than one copy of any of these gene sequences. In some embodiments, the engineered bacteria or engineered oncolytic virus comprises sequence(s) encoding two or more copies of an agonistic anti-CD40 antibody, an agonistic anti-CD40 antibody fragment, a CD40 ligand (CD40L) polypeptide, or a CD40L polypeptide fragment, e.g., two, three, four, five, six or more copies of any of these sequences. In some embodiments, the engineered bacteria or engineered oncolytic virus comprises sequence(s) to encode an agonistic anti-CD28 antibody, an agonistic anti-CD28 antibody fragment, a CD80 polypeptide, a CD80 polypeptide fragment, a CD86 polypeptide or a CD86 polypeptide fragment and sequence to encode a secretory peptide(s) for the secretion of said antibodies and polypeptides. In any of these embodiments, the genetically engineered bacteria or genetically engineered oncolytic viruses is a tumor-targeting bacterium or tumor-targeting oncolytic virus. In some embodiments, the genetically engineered bacterium or genetically engineered oncolytic virus expresses an agonistic anti-CD28 antibody, an agonistic anti-CD28 antibody fragment, a CD80 polypeptide, a CD80 polypeptide fragment, a CD86 polypeptide or a CD86 polypeptide fragment and/or expresses secretory peptide(s) under the control of a promoter that is activated by low-oxygen conditions. In some embodiments, the genetically engineered bacterium or genetically engineered oncolytic virus is a tumor-targeting bacterium or tumor-targeting oncolytic virus that expresses an agonistic anti-CD28 antibody, an agonistic anti-CD28 antibody fragment, a CD80 polypeptide, a CD80 polypeptide fragment, a CD86 polypeptide or a CD86 polypeptide fragment and/or expresses secretory peptide(s) under the control of a promoter that is activated by low-oxygen conditions. In certain embodiments, the genetically engineered bacteria or genetically engineered oncolytic viruses express an agonistic anti-CD28 antibody, an agonistic anti-CD28 antibody fragment, a CD80 polypeptide, a CD80 polypeptide fragment, a CD86 polypeptide or a CD86 polypeptide fragment and/or secretory peptide(s), under the control of a promoter that is activated by hypoxic conditions, or by inflammatory conditions, such as any of the promoters activated by said conditions and described herein. In some embodiments, the genetically engineered bacteria or genetically engineered OV expresses an agonistic anti-CD28 antibody, an agonistic anti-CD28 antibody fragment, a CD80 polypeptide, a CD80 polypeptide fragment, a CD86 polypeptide or a CD86 polypeptide fragment and/or expresses secretory peptide(s), under the control of a cancer-specific promoter, a tissue-specific promoter, or a constitutive promoter, such as any of the promoters described herein.

ICOS is an inducible T-cell co-stimulator structurally and functionally related to CD28. In some embodiments, the anti-cancer molecule, e.g., immune modulator, is an agonist of ICOS, for example, an agonist selected from agonistic anti-ICOS antibody, agonistic anti-ICOS antibody fragment, ICOS ligand (ICOSL) polypeptide, and ICOSL polypeptide fragment. Thus, in some embodiments, the genetically engineered bacteria or genetically engineered oncolytic virus comprise sequence(s) encoding an agonistic anti-ICOS antibody, an agonistic anti-ICOS antibody fragment, a ICOSL polypeptide, or an ICOSL polypeptide fragment. Thus, in some embodiments, the engineered bacteria or engineered oncolytic virus is engineered to produce an agonistic anti-ICOS antibody, an agonistic anti-ICOS antibody fragment, a ICOSL polypeptide, or an ICOSL polypeptide fragment. In some embodiments, the engineered bacteria or engineered oncolytic virus comprises sequence to encode an agonistic anti-ICOS antibody, an agonistic anti-ICOS antibody fragment, a ICOSL polypeptide, or an ICOSL polypeptide fragment. In some embodiments, the engineered bacteria or engineered oncolytic virus is engineered to over-express an agonistic anti-ICOS antibody, an agonistic anti-ICOS antibody fragment, a ICOSL polypeptide, or an ICOSL polypeptide fragment, for example, operatively linked to a strong promoter and/or comprising more than one copy of any of these gene sequences. In some embodiments, the engineered bacteria or engineered oncolytic virus comprises sequence(s) encoding two or more copies of an agonistic anti-ICOS antibody, an agonistic anti-ICOS antibody fragment, a ICOSL polypeptide, or an ICOSL polypeptide fragment, e.g., two, three, four, five, six or more copies of any of these sequences. In some embodiments, the engineered bacteria or engineered oncolytic virus comprises sequence(s) to encode an agonistic anti-ICOS antibody, an agonistic anti-ICOS antibody fragment, a ICOSL polypeptide, or an ICOSL polypeptide fragment and sequence to encode a secretory peptide(s) for the secretion of said antibodies and polypeptides. In any of these embodiments, the genetically engineered bacteria or genetically engineered oncolytic viruses is a tumor-targeting bacterium or tumor-targeting oncolytic virus. In some embodiments, the genetically engineered bacterium or genetically engineered oncolytic virus expresses an agonistic anti-ICOS antibody, an agonistic anti-ICOS antibody fragment, a ICOSL polypeptide, or an ICOSL polypeptide fragment and/or expresses secretory peptide(s) under the control of a promoter that is activated by low-oxygen conditions. In some embodiments, the genetically engineered bacterium or genetically engineered oncolytic virus is a tumor-targeting bacterium or tumor-targeting oncolytic virus that expresses an agonistic anti-ICOS antibody, an agonistic anti-ICOS antibody fragment, a ICOSL polypeptide, or an ICOSL polypeptide fragment and/or expresses secretory peptide(s) under the control of a promoter that is activated by low-oxygen conditions. In certain embodiments, the genetically engineered bacteria or genetically engineered oncolytic viruses express an agonistic anti-ICOS antibody, an agonistic anti-ICOS antibody fragment, a ICOSL polypeptide, or an ICOSL polypeptide fragment and/or secretory peptide(s), under the control of a promoter that is activated by hypoxic conditions, or by inflammatory conditions, such as any of the promoters activated by said conditions and described herein. In some embodiments, the genetically engineered bacteria or genetically engineered OV expresses an agonistic anti-ICOS antibody, an agonistic anti-ICOS antibody fragment, a ICOSL polypeptide, or an ICOSL polypeptide fragment and/or expresses secretory peptide(s), under the control of a cancer-specific promoter, a tissue-specific promoter, or a constitutive promoter, such as any of the promoters described herein.

CD226 is a glycoprotein expressed on the surface of natural killer cells, platelets, monocytes, and a subset of T cells (e.g., CD8+ and CD4+ cells), which mediates cellular adhesion to other cells bearing its ligands, CD112 and CD155. Among other things, it is involved in immune synapse formation and triggers Natural Killer (NK) cell activation. In some embodiments, the anti-cancer molecule, e.g., immune modulator is an agonist of CD226, for example, an agonist selected from agonistic anti-CD226 antibody, agonistic anti-CD266 antibody fragment, CD112 polypeptide, CD112 polypeptide fragment, CD155 polypeptide, and CD155 polypeptide fragment. Thus, in some embodiments, the genetically engineered bacteria or genetically engineered oncolytic virus comprise sequence(s) encoding an agonistic anti-CD226 antibody, an agonistic anti-CD226 antibody fragment, a CD112 polypeptide, a CD112 polypeptide fragment, a CD155 polypeptide, or a CD155 polypeptide fragment. Thus, in some embodiments, the engineered bacteria or engineered oncolytic virus is engineered to produce an agonistic anti-CD226 antibody, agonistic anti-CD266 antibody fragment, CD112 polypeptide, CD112 polypeptide fragment, CD155 polypeptide, and CD155 polypeptide fragment. In some embodiments, the engineered bacteria or engineered oncolytic virus comprises sequence to encode an agonistic anti-CD226 antibody, agonistic anti-CD266 antibody fragment, CD112 polypeptide, CD112 polypeptide fragment, CD155 polypeptide, and CD155 polypeptide fragment. In some embodiments, the engineered bacteria or engineered oncolytic virus is engineered to over-express an agonistic anti-CD226 antibody, agonistic anti-CD266 antibody fragment, CD112 polypeptide, CD112 polypeptide fragment, CD155 polypeptide, and CD155 polypeptide fragment, for example, operatively linked to a strong promoter and/or comprising more than one copy of any of these gene sequences. In some embodiments, the engineered bacteria or engineered oncolytic virus comprises sequence(s) encoding two or more copies of an agonistic anti-CD226 antibody, agonistic anti-CD266 antibody fragment, CD112 polypeptide, CD112 polypeptide fragment, CD155 polypeptide, and CD155 polypeptide fragment, e.g., two, three, four, five, six or more copies of any of these sequences. In some embodiments, the engineered bacteria or engineered oncolytic virus comprises sequence(s) to encode an agonistic anti-CD226 antibody, agonistic anti-CD266 antibody fragment, CD112 polypeptide, CD112 polypeptide fragment, CD155 polypeptide, and CD155 polypeptide fragment and sequence to encode a secretory peptide(s) for the secretion of said antibodies and polypeptides. In any of these embodiments, the genetically engineered bacteria or genetically engineered oncolytic viruses is a tumor-targeting bacterium or tumor-targeting oncolytic virus. In some embodiments, the genetically engineered bacterium or genetically engineered oncolytic virus expresses an agonistic anti-CD226 antibody, agonistic anti-CD266 antibody fragment, CD112 polypeptide, CD112 polypeptide fragment, CD155 polypeptide, and CD155 polypeptide fragment and/or expresses secretory peptide(s) under the control of a promoter that is activated by low-oxygen conditions. In some embodiments, the genetically engineered bacterium or genetically engineered oncolytic virus is a tumor-targeting bacterium or tumor-targeting oncolytic virus that expresses an agonistic anti-CD226 antibody, agonistic anti-CD266 antibody fragment, CD112 polypeptide, CD112 polypeptide fragment, CD155 polypeptide, and CD155 polypeptide fragment and/or expresses secretory peptide(s) under the control of a promoter that is activated by low-oxygen conditions. In certain embodiments, the genetically engineered bacteria or genetically engineered oncolytic viruses express an agonistic anti-CD226 antibody, agonistic anti-CD266 antibody fragment, CD112 polypeptide, CD112 polypeptide fragment, CD155 polypeptide, and CD155 polypeptide fragment and/or secretory peptide(s), under the control of a promoter that is activated by hypoxic conditions, or by inflammatory conditions, such as any of the promoters activated by said conditions and described herein. In some embodiments, the genetically engineered bacteria or genetically engineered OV expresses an agonistic anti-CD226 antibody, agonistic anti-CD266 antibody fragment, CD112 polypeptide, CD112 polypeptide fragment, CD155 polypeptide, and CD155 polypeptide fragment and/or expresses secretory peptide(s), under the control of a cancer-specific promoter, a tissue-specific promoter, or a constitutive promoter, such as any of the promoters described herein.

CD137 or 4-1BB is is a type 2 transmembrane glycoprotein belonging to the TNF superfamily, which is expressed and has a co-stimulatory activity on activated T Lymphocytes (e.g., CD8+ and CD4+ cells). It has been shown to enhance T cell proliferation, IL-2 secretion survival and cytolytic activity. In some embodiments, the anti-cancer molecule, e.g., immune modulator, is an agonist of CD137 (4-1BB), for example, an agonist selected from agonistic anti-CD137 antibody, agonistic anti-CD137 antibody fragment, CD137 ligand polypeptide (CD137L), and CD137L polypeptide fragment. Thus, in some embodiments, the genetically engineered bacteria or genetically engineered oncolytic virus comprise sequence(s) encoding an agonistic anti-CD137 antibody, an agonistic anti-CD137 antibody fragment, a CD137 ligand polypeptide, or a CD137 ligand polypeptide fragment. Thus, in some embodiments, the engineered bacteria or engineered oncolytic virus is engineered to produce an agonistic anti-CD137 antibody, an agonistic anti-CD137 antibody fragment, a CD137 ligand polypeptide, or a CD137 ligand polypeptide fragment. In some embodiments, the engineered bacteria or engineered oncolytic virus comprises sequence to encode an agonistic anti-CD137 antibody, an agonistic anti-CD137 antibody fragment, a CD137 ligand polypeptide, or a CD137 ligand polypeptide fragment. In some embodiments, the engineered bacteria or engineered oncolytic virus is engineered to over-express an agonistic anti-CD137 antibody, an agonistic anti-CD137 antibody fragment, a CD137 ligand polypeptide, or a CD137 ligand polypeptide fragment, for example, operatively linked to a strong promoter and/or comprising more than one copy of any of these gene sequences. In some embodiments, the engineered bacteria or engineered oncolytic virus comprises sequence(s) encoding two or more copies of an agonistic anti-CD137 antibody, an agonistic anti-CD137 antibody fragment, a CD137 ligand polypeptide, or a CD137 ligand polypeptide fragment, e.g., two, three, four, five, six or more copies of any of these sequences. In some embodiments, the engineered bacteria or engineered oncolytic virus comprises sequence(s) to encode an agonistic anti-CD137 antibody, an agonistic anti-CD137 antibody fragment, a CD137 ligand polypeptide, or a CD137 ligand polypeptide fragment, and sequence to encode a secretory peptide(s) for the secretion of said antibodies and polypeptides. In any of these embodiments, the genetically engineered bacteria or genetically engineered oncolytic viruses is a tumor-targeting bacterium or tumor-targeting oncolytic virus. In some embodiments, the genetically engineered bacterium or genetically engineered oncolytic virus expresses an agonistic anti-CD137 antibody, an agonistic anti-CD137 antibody fragment, a CD137 ligand polypeptide, or a CD137 ligand polypeptide fragment, and/or expresses secretory peptide(s) under the control of a promoter that is activated by low-oxygen conditions. In some embodiments, the genetically engineered bacterium or genetically engineered oncolytic virus is a tumor-targeting bacterium or tumor-targeting oncolytic virus that expresses agonistic anti-CD137 antibody, an agonistic anti-CD137 antibody fragment, a CD137 ligand polypeptide, or a CD137 ligand polypeptide fragment, and/or expresses secretory peptide(s) under the control of a promoter that is activated by low-oxygen conditions. In certain embodiments, the genetically engineered bacteria or genetically engineered oncolytic viruses express an agonistic anti-CD137 antibody, an agonistic anti-CD137 antibody fragment, a CD137 ligand polypeptide, or a CD137 ligand polypeptide fragment, and/or secretory peptide(s), under the control of a promoter that is activated by hypoxic conditions, or by inflammatory conditions, such as any of the promoters activated by said conditions and described herein. In some embodiments, the genetically engineered bacteria or genetically engineered OV expresses an agonistic anti-CD137 antibody, an agonistic anti-CD137 antibody fragment, a CD137 ligand polypeptide, or a CD137 ligand polypeptide fragment, and/or expresses secretory peptide(s), under the control of a cancer-specific promoter, a tissue-specific promoter, or a constitutive promoter, such as any of the promoters described herein.

OX40, or CD134, is a T-cell receptor involved in preserving the survival of Tcells and subsequently increasing cytokine production. OX40 has a critical role in the maintenance of an immune response and a memory response due to its ability to enhance survival. It also plays a significant role in both Th1 and Th2 mediated reactions. In some embodiments, the anti-cancer molecule, e.g., immune modulator, is an agonist of OX40, for example, an agonist selected from agonistic anti-OX40 antibody, agonistic anti-OX40 antibody fragment, OX40 ligand (OX40L), and OX40L fragment. Thus, in some embodiments, the genetically engineered bacteria or genetically engineered oncolytic virus comprise sequence(s) encoding an agonistic anti-OX40 or anti-CD134 antibody, an agonistic anti-OX40 or anti-CD134 antibody fragment, a OX40L polypeptide, or a OX40L polypeptide fragment. Thus, in some embodiments, the engineered bacteria or engineered oncolytic virus is engineered to produce an agonistic anti-OX40 or anti-CD134 antibody, an agonistic anti-OX40 or anti-CD134 antibody fragment, a OX40L polypeptide, or a OX40L polypeptide fragment. In some embodiments, the engineered bacteria or engineered oncolytic virus comprises sequence to encode an agonistic anti-OX40 or anti-CD134 antibody, an agonistic anti-OX40 or anti-CD134 antibody fragment, a OX40L polypeptide, or a OX40L polypeptide fragment. In some embodiments, the engineered bacteria or engineered oncolytic virus is engineered to over-express an agonistic anti-OX40 or anti-CD134 antibody, an agonistic anti-OX40 or anti-CD134 antibody fragment, a OX40L polypeptide, or a OX40L polypeptide fragment for example, operatively linked to a strong promoter and/or comprising more than one copy of any of these gene sequences. In some embodiments, the engineered bacteria or engineered oncolytic virus comprises sequence(s) encoding two or more copies of an agonistic anti-OX40 or anti-CD134 antibody, an agonistic anti-OX40 or anti-CD134 antibody fragment, a OX40L polypeptide, or a OX40L polypeptide fragment, e.g., two, three, four, five, six or more copies of any of these sequences. In some embodiments, the engineered bacteria or engineered oncolytic virus comprises sequence(s) to encode an agonistic anti-OX40 or anti-CD134 antibody, an agonistic anti-OX40 or anti-CD134 antibody fragment, a OX40L polypeptide, or a OX40L polypeptide fragment and sequence to encode a secretory peptide(s) for the secretion of said antibodies and polypeptides. In any of these embodiments, the genetically engineered bacteria or genetically engineered oncolytic viruses is a tumor-targeting bacterium or tumor-targeting oncolytic virus. In some embodiments, the genetically engineered bacterium or genetically engineered oncolytic virus expresses an agonistic anti-OX40 or anti-CD134 antibody, an agonistic anti-OX40 or anti-CD134 antibody fragment, a OX40L polypeptide, or a OX40L polypeptide fragment and/or expresses secretory peptide(s) under the control of a promoter that is activated by low-oxygen conditions. In some embodiments, the genetically engineered bacterium or genetically engineered oncolytic virus is a tumor-targeting bacterium or tumor-targeting oncolytic virus that expresses agonistic anti-OX40 or anti-CD134 antibody, an agonistic anti-OX40 or anti-CD134 antibody fragment, a OX40L polypeptide, or a OX40L polypeptide fragment and/or expresses secretory peptide(s) under the control of a promoter that is activated by low-oxygen conditions. In certain embodiments, the genetically engineered bacteria or genetically engineered oncolytic viruses express an agonistic anti-OX40 or anti-CD134 antibody, an agonistic anti-OX40 or anti-CD134 antibody fragment, a OX40L polypeptide, or a OX40L polypeptide fragment and/or secretory peptide(s), under the control of a promoter that is activated by hypoxic conditions, or by inflammatory conditions, such as any of the promoters activated by said conditions and described herein. In some embodiments, the genetically engineered bacteria or genetically engineered OV expresses an agonistic anti-OX40 or anti-CD134 antibody, an agonistic anti-OX40 or anti-CD134 antibody fragment, a OX40L polypeptide, or a OX40L polypeptide fragment and/or expresses secretory peptide(s), under the control of a cancer-specific promoter, a tissue-specific promoter, or a constitutive promoter, such as any of the promoters described herein.

In any of these embodiments, the antibody may be a human antibody or humanized antibody and may comprise different isotypes, e.g., human IgG1, IgG2, IgG3 and IgG4's. Also, the antibody may comprise a constant region that is modified to increase or decrease an effector function such as FcR binding, FcRn binding, complement function, glycosylation, C1q binding; complement dependent cytotoxicity (CDC); Fc receptor binding; antibody-dependent cell-mediated cytotoxicity (ADCC); phagocytosis; down-regulation of cell surface receptors (e.g. B cell receptor; BCR). In any of these embodiments, the antibody may be a single chain chain antibody or a single chain antibody fragment.

Antigens/Vaccines

Antigens stimulate a number of cells in the immune system, including macrophages, T cells, and B cells. Macrophages ingest antigens such as proteins entering the body and digest them into antigen fragments. A molecule called MHC (major histocompatibility complex) carries certain of these fragments to the surface of the cell, where they are displayed but they are still locked into the cleft of the MHC molecule. These displayed antigen fragments are recognized by T cells, which stimulate B cells to secrete antibodies to the fragments as well as prompt other immune defenses. Any protein that is not exposed to the immune system triggers an immune response. This may include normal proteins that are sequestered from the immune system, proteins that are normally produced in extremely small quantities, proteins that are normally produced only in certain stages of development, proteins whose structure is modified due to mutation, and proteins that are derived from foreign agents. The genetically engineered microorganisms can be engineered to produce and secrete antigens that, upon delivery to the tumor site, will stimulate an immune response in the tumor microenvironment. Alternatively, the genetically engineered microorganisms can be engineered to produce an antigen that is anchored to its cell membrane which, upon delivery to the tumor site, will stimulate an immune response in the tumor microenvironment.

A category of useful antigens are tumor antigens. As used herein the term "tumor antigen" is meant to refer to tumor-specific antigens, tumor-associated antigens (TAAs), and neoantigens. Tumor antigens are antigenic molecules produced in tumor cells that trigger an immune response in the host. These tumor specific antigens or tumor-associated antigens (TAAs) may be specific to a particular type of cancer cell or tumor cell and therefore the generated immune response will be directed to that cancer or tumor cell type.

Tumor-specific antigens may be encoded by a primary open reading frame of gene products that are differentially expressed by tumors, and not by normal tissues. They may also be encoded by mutated genes, intronic sequences, or translated alternative open reading frames, pseudogenes, antisense strands, or represent the products of gene translocation events.

Tumor-associated antigens (TAA) can be derived from any protein or glycoprotein synthesized by the tumor cell. TAA proteins can reside in any subcellular compartment of the tumor cell; ie, they may be membrane-bound or found in an intracellular compartment.

Tumor antigens are classified based on their molecular structure and source. Any protein produced in a tumor cell that has an abnormal structure due to mutation can act as a tumor antigen. Mutation of protooncogenes and tumor suppressors which lead to abnormal protein production are the cause of the tumor and thus such abnormal proteins are called tumor-specific antigens. Examples of tumor antigens include products of mutated oncogenes and tumor suppressor genes. Mutation of protooncogenes and tumor suppressors which lead to abnormal protein production are the cause of the tumor and thus such abnormal proteins are called tumor-specific antigens. Examples of tumor-specific antigens include the abnormal products of ras and p53 genes. Thus, mutated antigens are only expressed by cancer as a result of genetic mutation or alteration in transcription.

In contrast, mutation of other genes unrelated to the tumor formation may lead to synthesis of abnormal proteins which are called tumor-associated antigens. These tumor-associated antigens are the products of other mutated genes that are overexpressed or aberrantly expressed cellular proteins. These overexpressed/accumulated antigens are expressed by both normal and neoplastic tissue, with the level of expression highly elevated in neoplasia. It should be noted that the classifications of "tumor specific antigen" and "tumor associated antigen" or of any of the "classes" described below are not meant to be mutually exclusive, there is overlap between the different "classes" with many tumor antigens falling into more than one "class"; thus the terminology is meant to be a general way of categorizing or grouping tumor antigens based on their characteristics and origin.

Oncogenic viral antigens are those antigens implicated in forming cancer (oncogenesis), and some viral antigens are also cancer antigens. Abnormal proteins are also produced by cells infected with oncoviruses, e.g. EBV and HPV. Cells infected by these viruses contain latent viral DNA which is transcribed and the resulting protein produces an immune response. Thus, tumor antigens produced by oncogenic viruses are those encoded by tumorigenic transforming viruses.

Oncofetal antigens are another important class of tumor antigens that are typically only expressed in fetal tissues and in cancerous somatic cells. Examples are alphafetoprotein (AFP) and carcinoembryonic antigen (CEA). These proteins are normally produced in the early stages of embryonic development and disappear by the time the immune system is fully developed. Thus self-tolerance does not develop against these antigens.

In addition to proteins, other substances like cell surface glycolipids and glycoproteins may also have an abnormal structure in tumor cells and could thus be targets of the immune system. Thus, other antigens are altered cell surface glycolipids and glycoproteins that are posttranslationally altered, e.g., have tumor-associated alterations in glycosylation.

Other examples include tissue differentiation antigens, which are antigens that are specific to a certain type of tissue. Mutant protein antigens are more specific to cancer cells because normal cells do not typically contain these proteins. Normal cells will display the normal protein antigen on their MHC molecules, whereas cancer cells will display the mutant version. Cell type-specific differentiation antigens are lineage-restricted (expressed largely by a single cancer histotype). There are also vascular or stromal specific antigens.

Cancer-testis antigens are expressed only by cancer cells and adult reproductive tissues such as testis and placenta. Cancer-testis antigens are antigens expressed primarily in the germ cells of the testes, but also in fetal ovaries and the trophoblast. Some cancer cells aberrantly express these proteins and therefore present these antigens, allowing attack by T-cells specific to these antigens. Example antigens of this type are CTAG1B and MAGEA1.

Idiotypic antigens are highly polymorphic genes where a tumor cell expresses a specific "clonotype", ie, as in B cell, T cell lymphoma/leukemia resulting from clonal aberrancies.

Proteins that are normally produced in very low quantities but whose production is dramatically increased in tumor cells, trigger an immune response. An example of such a protein is the enzyme tyrosinase, which is required for melanin production. Normally tyrosinase is produced in minute quantities but its levels are very much elevated in melanoma cells.

In addition to these types of antigens, there are also known neoantigens which can be used to stimulate an immune response. The genetically engineered microorganisms function to stimulate an immune response in the tumor microenvironment, which immune response results in tumor cell lysis. Moreover, the engineered microbes can also be further engineered as provided herein to stimulate an immune response an immune response in the tumor microenvironment, for example, the engineered microorganisms can be engineered to produce one or more lytic peptides. Upon lysis of the tumor cells, neoantigens are released and presented to antigen presenting cells, leading to immune-mediated antitumor responses. The killing of cancer cells can result in the release of novel cancer antigens (neoantigens) that may have been previously hidden to the immune system due to restricted presentation. Such neoantigens can be taken up by local APCs in the context of a pro-inflammatory environment, which can trigger an immune response against the neo-antigen, killing the antigen-expressing cancer cells (including those cancer cells located at a distant site).

There are numerous known tumor antigens, e.g., tumor specific antigens, TAAs and neoantigens to date, many of which are associated with certain tumors and cancer cells. These tumor antigens are typically small peptide antigens, associated with a certain cancer cell type, which are known to stimulate an immune response. By introducing such tumor antigens, e.g., tumor-specific antigens, TAA(s), and/or neoantigen(s) to the local tumor environment, an immune response can be raised against the particular cancer or tumor cell of interest known to be associated with that neoantigen.

The engineered microorganisms can be engineered such that the peptides, e.g. tumor antigens, can be anchored in the microbial cell wall (e.g., at the microbial cell surface). These are known as wall anchored antigens. For example, the peptide antigen can be modified for C-terminal cell wall anchoring using plasmids that contain a secretion cassette translationally fused to a promoter (e.g., inducible or constitutive) which drives the expression of the tumor peptide. Other wall anchoring sequences can be derived from Lp_2578 (lp_2578 cell surface adherence protein, collagen-binding domain, LPXTG-motif cell wall anchor [*Lactobacillus plantarum* WCFS1] Gene ID: 1062801). Lp_2578 includes a signal peptide cleavage site, an LPxTG motif, and a proline-rich motif that may be adapted to a location inside the peptidoglycan layer (Fischetti, V. A., V. Pancholi, and O. Schneewind. 1990. Conservation of a hexapeptide sequence in the anchor region of surface proteins from gram-positive cocci. Mol. Microbiol. 4:1603-1605.) In addition to an N-terminal signal peptide-based transmembrane anchors, various other surface anchoring strategies are known, including a lipobox-based covalent membrane anchor, sortase-mediated covalent cell wall anchoring, LysM-based non-covalent cell wall anchoring (Kuckowska et al., Microb Cell Fact. 2015; 14: 169. *Lactobacillus plantarum* displaying CCL3 chemokine in fusion with HIV-1 Gag derived antigen causes increased recruitment of T cells).

Bacterial expression of wall anchored antigens is for example described in (Mobergslien et al., Hum Vaccin Immunother. 2015; 11(11):2664-73. Recombinant *Lactobacillus plantarum* induces immune responses to cancer testis antigen NY-ESO-1 and maturation of dendritic cells). Such antigens known to stimulate an immune response have been described in a number of studies. For example, animals receiving orally administered *Lactobacillus casei* expressing human papillomavirus type 16 E7 antigen showed reduced tumor size and increased survival rate versus mice receiving control in an E7-based mouse tumor model (Poo et al., Int J Cancer. 2006 Oct. 1; 119(7):1702-9. Oral administration of human papillomavirus type 16 E7 displayed on *Lactobacillus casei* induces E7-specific antitumor effects in C57/BL6 mice). *Lactobacillus* (L) *plantarum* WCFS1 expressing secreted antigens or a cell-wall anchored tumor antigens, such as NY-ESO-1 and oncofetal protein, are able to induce specific T-cell responses in mice. (Mobergslien A et al., Hum Vaccin Immunother. 2015; 11(11):2664-73. *Listeria monocytogenes* has been used for the for delivery of tumor antigens, such as PSA (prostat specific antigen), causing regression of established tumors accompanied by strong immune responses toward these antigens in murine models of prostate cancer Shahbi et al, Cancer Immunol Immunother. 2008 September; 57(9):1301-13. Development of a *Listeria monocytogenes* based vaccine against prostate cancer). Recombinant *Lactobacillus plantarum* induces immune responses to cancer testis antigen NY-ESO-1 and maturation of dendritic cells and Fredriksen et al., Appl Environ Microbiol. 2010 November; 76(21): 7359-7362. Cell Wall Anchoring of the 37-Kilodalton Oncofetal Antigen by *Lactobacillus plantarum* for Mucosal Cancer Vaccine Delivery).

Thus, in some embodiments, the engineered microorganisms of the present disclosure, e.g., genetically engineered bacteria or genetically engineered oncolytic viruses, are engineered to produce one or more tumor antigens. In some embodiments, the genetically engineered bacteria or genetically engineered oncolytic viruses are engineered to produce one or more tumor-specific antigens. In some embodiments, the genetically engineered bacteria or genetically engineered oncolytic viruses are engineered to produce one or more tumor-associated antigens. In some embodiments, the genetically engineered bacteria or genetically engineered oncolytic viruses are engineered to produce one or more neoantigens. In some embodiments, the genetically engineered bacteria or genetically engineered oncolytic viruses are engineered to produce one or more antigens selected from oncogenic viral antigens, oncofetal antigens, altered cell surface glycolipids and glycoproteins, tissue differentiation antigens, cancer-testis antigens, and idiotypic antigens. Exemplary tumor antigens, e.g., tumor-specific antigens, tumor-associated antigens, and/or neoantigen(s) are provided herein and otherwise known in the art.

In some embodiments, the genetically engineered bacteria or genetically engineered oncolytic virus are engineered to produce two or more, e.g., two, three, four, five, six, seven, eight, nine, ten or more tumor antigens, e.g., tumor specific antigens, tumor-associated antigens, and/or neoantigen(s), for example, any of the tumor specific antigens, tumor-associated antigens, and/or neoantigen(s) provided herein and otherwise known in the art. In some embodiments in which two or more tumor antigens are encoded, the tumor specific antigens, tumor-associated antigens, and/or neoantigen(s) are the same tumor specific antigen, tumor-associated antigens, or neoantigen. In some embodiments in which two or more tumor antigens are encoded, the tumor specific antigens, tumor-associated antigens, and/or neoantigen(s) are different tumor specific antigens, tumor-associated antigens, and/or neoantigen(s). In some embodiments in which two or more tumor antigens are encoded, each tumor specific antigen(s), tumor-associated antigen(s), and/or neoantigen(s) is encoded separately. In some embodiments in which two or more antigens are encoded, the genetically engineered bacteria or genetically engineered oncolytic viruses are engineered to encode one or more concatameric polypeptide(s) comprising two or more, e.g., two, three, four, five, six, seven, eight, nine, ten, twenty, thirty, forty, fifty, or more antigenic peptides on a single concatameric polypeptide. The resulting contameric polypeptide has multiple antigenic peptides, like beads on a string.

In some embodiments, the antigens are secreted into the tumor microenvironment, where they are taken up by immune cells for antigen presentation. Thus, in some embodiments, the genetically engineered bacteria or oncolytic virus comprise sequence(s) for encoding one or more tumor antigens, e.g., tumor-specific antigens, tumor-associated antigens, and/or neoantigen(s), and sequence that allows for the secretion of the antigens, such as any of the secretion systems, methods and sequences described herein. In some embodiments, the antigens are anchored to the engineered microbial cell wall, membrane, or capsid. Thus, in some embodiments, the genetically engineered bacteria or oncolytic virus are engineered to produce one or more tumor antigens, e.g., tumor-specific antigens, tumor-associated antigens, and/or neoantigen(s), that are a wall anchored antigen(s). In some embodiments, the genetically engineered bacteria or oncolytic virus comprise sequence(s) for encoding one or more tumor antigens, e.g., tumor-specific antigens, tumor-associated antigens, and/or neoantigen(s), and sequence that targets the antigens to the cell wall, membrane or capsid, such as any of the cell wall targeting methods and sequences described herein. In some embodiments, the engineered microorganisms encode one or more gene sequence(s) encoding one or more MHC class I binding peptides. In some embodiments, the bacteria encode one or more gene sequence(s) encoding one or more MHC class II binding peptides.

Non-limiting examples of tumor antigens, tumor-associated antigens, and neoantigens are included in Tables 26-32 below.

TABLE 26

Selected mutated antigens (Neoantigens)

| Gene/protein | Tumor | Peptidec |
|---|---|---|
| alpha-actinin-4<br>SEQ ID NO: 160 | lung carcinoma | FIASNGVKLV |
| ARTC1<br>SEQ ID NO: 161 | melanoma | YSVYFNLPADTIYTNh |
| BCR-ABL fusion protein<br>(b3a2)<br>SEQ ID NO: 162<br>SEQ ID NO: 163<br>SEQ ID NO: 164 | chronic myeloid<br>leukemia | <br><br>SSKALQRPV<br>GFKQSSKAL<br>ATGFKQSSKALQRPVAS |
| B-RAF<br>SEQ ID NO: 165 | melanoma | EDLTVKIGDFGLATEKSRWSGSHQF<br>EQLS |
| CASP-5<br>SEQ ID NO: 166 | colorectal, gastric,<br>and endometrial<br>carcinoma | FLIIWQNTMg |
| CASP-8<br>SEQ ID NO: 167 | head and neck<br>squamous cell<br>carcinoma | FPSDSWCYF |
| beta-catenin<br>SEQ ID NO: 168 | melanoma | SYLDSGIHF |
| Cdc27<br>SEQ ID NO: 169 | melanoma | FSWAMDLDPKGAe |
| CDK4<br>SEQ ID NO: 170 | melanoma | ACDPHSGHFV |
| CDK12<br>SEQ ID NO: 171 | melanoma | CILGKLFTK |
| CDKN2A<br>SEQ ID NO: 172 | melanoma | AVCPWTWLRg |
| CLPP<br>SEQ ID NO: 173 | melanoma | ILDKVLVHL |
| COA-1<br>SEQ ID NO: 174 | colorectal carcinoma | TLYQDDTLTLQAAGe |
| CSNK1A1<br>SEQ ID NO: 175 | melanoma | GLFGDIYLA |
| dek-can fusion protein<br>SEQ ID NO: 176 | myeloid leukemia | TMKQICKKEIRRLHQY |
| EFTUD2<br>SEQ ID NO: 177 | melanoma | KILDAVVAQK |
| Elongation factor 2<br>SEQ ID NO: 178 | lung squamous CC | ETVSEQSNV |
| ETV6-AML1 fusion protein<br>SEQ ID NO: 179<br>SEQ ID NO: 180 | acute lymphoblastic<br>leukemia | <br>RIAECILGMi<br>IGRIAECILGMNPSR |
| FLT3-ITD<br>SEQ ID NO: 181 | acute myelogenous<br>leukemia | YVDFREYEYY |
| FNDC3B<br>SEQ ID NO: 182 | chronic lymphocytic<br>leukemia | VVMSWAPPV |
| FN1<br>SEQ ID NO: 183 | melanoma | MIFEKHGFRRTTPP |
| GAS7<br>SEQ ID NO: 184 | melanoma | SLADEAEVYL |
| GPNMB<br>SEQ ID NO: 185 | melanoma | TLDWLLQTPK |

TABLE 26-continued

Selected mutated antigens (Neoantigens)

| Gene/protein | Tumor | Peptidec |
|---|---|---|
| HAUS3 SEQ ID NO: 186 | melanoma | ILNAMIAKIj |
| HSDL1 SEQ ID NO: 187 | ovarian cancer | CYMEAVAL |
| LDLR-fucosyltransferaseAS SEQ ID NO: 188 | melanoma | WRRAPAPGA |
| fusion protein SEQ ID NO: 189 | | PVTWRRAPA |
| HLA-A2d SEQ ID NO: 190 | renal cell carcinoma | |
| HLA-A11d SEQ ID NO: 191 | melanoma | |
| hsp70-2 SEQ ID NO: 192 | renal cell carcinoma | SLFEGIDIYT |
| SEQ ID NO: 193 | bladder tumor | AEPINIQTW |
| MART2 SEQ ID NO: 194 | melanoma | FLEGNEVGKTY |
| MATN SEQ ID NO: 195 | melanoma | KTLTSVFQK |
| ME1 SEQ ID NO: 196 | non-small cell lung carcinoma | FLDEFMEGV |
| MUM-1f SEQ ID NO: 197 | melanoma | EEKLIVVLF |
| MUM-2 SEQ ID NO: 198 SEQ ID NO: 199 | melanoma | SELFRSGLDSY FRSGLDSYV |
| MUM-3 SEQ ID NO: 200 | melanoma | EAFIQPITR |
| neo-PAP SEQ ID NO: 201 | melanoma | RVIKNSIRLTLe |
| Myosin class I SEQ ID NO: 202 | melanoma | KINKNPKYK |
| NFYC SEQ ID NO: 203 | lung squamous cell carcinoma | QQITKTEV |
| OGT SEQ ID NO: 204 | colorectal carcinoma | SLYKFSPFPLg |
| OS-9 SEQ ID NO: 205 | melanoma | KELEGILLL |
| p53 SEQ ID NO: 206 | head and neck squamous cell carcinoma | VVPCEPPEV |
| pml-RARalpha fusion protein SEQ ID NO: 207 | promyelocytic leukemia | NSNHVASGAGEAAIETQSSSSEEIV |
| PPP1R3B SEQ ID NO: 208 | melanoma | YTDFHCQYV |
| PRDX5 SEQ ID NO: 209 | melanoma | LLLDDLLVSI |
| PTPRK SEQ ID NO: 210 | melanoma | PYYFAAELPPRNLPEP |
| K-ras SEQ ID NO: 211 | pancreatic adenocarcinoma | VVVGAVGVG |

TABLE 26-continued

Selected mutated antigens (Neoantigens)

| Gene/protein | Tumor | Peptidec |
|---|---|---|
| N-ras SEQ ID NO: 212 | melanoma | ILDTAGREEY |
| RBAF600 SEQ ID NO: 213 | melanoma | RPHVPESAF |
| SIRT2 SEQ ID NO: 214 | melanoma | KIFSEVTLK |
| SNRPD1 SEQ ID NO: 215 | melanoma | SHETVIIEL |
| SYT-SSX1 or -SSX2 fusion protein SEQ ID NO: 216 | sarcoma | QRPYGYDQIM |
| TGF-betaRII SEQ ID NO: 217 | colorectal carcinoma | RLSSCVPVAg |
| Triosephosphate isomerase SEQ ID NO: 218 | melanoma | GELIGILNAAKVPAD |

TABLE 27

Selected Tumor Associated Antigens

Cyclin-A1

| | | |
|---|---|---|
| SEQ ID NO: 219 A2 | 44 | FLDRFLSCM |
| SEQ ID NO: 220 A2 | 44 | SLIAAAAFCLA |

GAGE-1, 2, 8

| | | |
|---|---|---|
| SEQ ID NO: 221 Cw6 | 18 | YRPRPRRY |

GAGE-3, 4, 5, 6, 7

| | | |
|---|---|---|
| SEQ ID NO: 222 A29 | 6 | YYWPRPRRY |

GnTVf

| | | |
|---|---|---|
| SEQ ID NO: 223 A2 | 44 | VLPDVFIRC(V) |

HERV-K-MEL

| | | |
|---|---|---|
| SEQ ID NO: 224 A2 | 44 | MLAVISCAV |

KK-LC-1

| | | |
|---|---|---|
| SEQ ID NO: 225 B15 | 13 | RQKRILVNL |

KM-HN-1

| | | |
|---|---|---|
| SEQ ID NO: 226 A24 | 20 | NYNNFYRFL |
| SEQ ID NO: 227 A24 | 20 | EYSKECLKEF |
| SEQ ID NO: 228 A24 | 20 | EYLSLSDKI |

LAGE-1

| | | |
|---|---|---|
| SEQ ID NO: 229 A2 | 44 | MLMAQEALAFL |
| SEQ ID NO: 230 A2 | 44 | SLLMWITQC |
| SEQ ID NO: 231 A31 | 5 | LAAQERRVPR |
| SEQ ID NO: 232 A68 | 8 | ELVRRILSR |
| SEQ ID NO: 233 B7 | 17 | APRGVRMAV |
| SEQ ID NO: 234 DP4 | 75 | SLLMWITQCFLPVF |
| SEQ ID NO: 235 DR3 | 21 | QGAMLAAQERRVPRAAEVPR |
| SEQ ID NO: 236 DR4 | 24 | AADHRQLQLSISSCLQQL |
| SEQ ID NO: 237 DR11 | 25 | CLSRRPWKRSWSAGSCPGMPHL |
| SEQ ID NO: 237 DR12 | 5 | CLSRRPWKRSWSAGSCPGMPHL |
| SEQ ID NO: 238 DR13 | 19 | ILSRDAAPLPRPG |
| SEQ ID NO: 239 DR15 | 20 | AGATGGRGPRGAGA |

LY6K

| | | |
|---|---|---|
| SEQ ID NO: 240 A24 | 20 | RYCNLEGPPI |
| SEQ ID NO: 241 DP5 | 3 | KWTEPYCVIAAVKIFPRFFMVAKQ |
| SEQ ID NO: 242 DR15 | 20 | KCCKIRYCNLEGPPINSSVF |

MAGE-A1

| | | |
|---|---|---|
| SEQ ID NO: 243 A1 | 26 | EADPTGHSY |
| SEQ ID NO: 243 A2 | 44 | KVLEYVIKV |
| SEQ ID NO: 244 A3 | 22 | SLFRAVITK |
| SEQ ID NO: 245 A68 | 8 | EVYDGREHSA |
| SEQ ID NO: 246 B7 | 17 | RVRFFFPSL |
| SEQ ID NO: 247 B35 | 20 | EADPTGHSY |
| SEQ ID NO: 248 B37 | 3 | REPVTKAEML |
| SEQ ID NO: 249 B44 | 21 | KEADPTGHSY |
| SEQ ID NO: 250 B53 | 2 | DPARYEFLW |
| SEQ ID NO: 251 B57 | 8 | ITKKVADLVGF |
| SEQ ID NO: 252 Cw2 | 10 | SAFPTTINF |
| SEQ ID NO: 253 Cw3 | 17 | SAYGEPRKL |
| SEQ ID NO: 254 Cw7 | 41 | RVRFFFPSL |
| SEQ ID NO: 255 Cw16 | 7 | SAYGEPRKL |
| SEQ ID NO: 256 DP4 | 75 | TSCILESLFRAVITK |
| SEQ ID NO: 257 DP4 | 75 | PRALAETSYVKVLEY |
| SEQ ID NO: 258 DR13 | 19 | FLLLKYRAREPVTKAE |
| SEQ ID NO: 259 DR15 | 20 | EYVIKVSARVRF |

MAGE-A2

| | | |
|---|---|---|
| SEQ ID NO: 260 A2 | 44 | YLQLVFGIEV |
| SEQ ID NO: 261 A24 | 20 | EYLQLVFGI |
| SEQ ID NO: 262 B37 | 3 | REPVTKAEML |
| SEQ ID NO: 263 Cw7 | 41 | EGDCAPEEK |
| SEQ ID NO: 264 DR13 | 19 | LLKYRAREPVTKAE |

MAGE-A3

| | | |
|---|---|---|
| SEQ ID NO: 265 A1 | 26 | EVDPIGHLY |
| SEQ ID NO: 266 A2 | 44 | FLWGPRALVd |
| SEQ ID NO: 267 A2 | 44 | KVAELVHFL |
| SEQ ID NO: 268 A24 | 20 | TFPDLESEF |
| SEQ ID NO: 269 A24 | 20 | VAELVHFLL |

TABLE 27-continued

Selected Tumor Associated Antigens

| SEQ ID NO: 270 | B18 | 6 | MEVDPIGHLY |
| SEQ ID NO: 271 | B35 | 20 | EVDPIGHLY |
| SEQ ID NO: 272 | B37 | 3 | REPVTKAEML |
| SEQ ID NO: 273 | B40 | 6 | AELVHFLLLi |
| SEQ ID NO: 274 | B44 | 21 | MEVDPIGHLY |
| SEQ ID NO: 275 | B52 | 5 | WQYFFPVIF |
| SEQ ID NO: 276 | Cw7 | 41 | EGDCAPEEK |
| SEQ ID NO: 277 | DP4 | 75 | KKLLTQHFVQENYLEY |
| SEQ ID NO: 278 | DP4 | 75 | RKVAELVHFLLLKYR |
| SEQ ID NO: 279 | DQ6 | 63 | KKLLTQHFVQENYLEY |
| SEQ ID NO: 280 | DR1 | 18 | ACYEFLWGPRALVETS |
| SEQ ID NO: 281 | DR4 | 24 | RKVAELVHFLLLKYR |
| SEQ ID NO: 282 | DR4 | 24 | VIFSKASSSLQL |
| SEQ ID NO: 282 | DR7 | 25 | VIFSKASSSLQL |
| SEQ ID NO: 283 | DR7 | 25 | VFGIELMEVDPIGHL |
| SEQ ID NO: 284 | DR11 | 25 | GDNQIMPKAGLLIIV |
| SEQ ID NO: 285 | DR11 | 25 | TSYVKVLHHMVKISG |
| SEQ ID NO: 286 | DR13 | 19 | RKVAELVHFLLLKYRA |
| SEQ ID NO: 287 | DR13 | 19 | FLLLKYRAREPVTKAE |

MAGE-A4

| SEQ ID NO: 288 | A1 | 26 | EVDPASNTYj |
| SEQ ID NO: 289 | A2 | 44 | GVYDGREHTV |
| SEQ ID NO: 290 | A24 | 20 | NYKRCPVI |
| SEQ ID NO: 291 | B37 | 3 | SESLKMIF |

MAGE-A6

| SEQ ID NO: 292 | A34 | 1 | MVKISGGPR |
| SEQ ID NO: 293 | B35 | 20 | EVDPIGHVY |
| SEQ ID NO: 294 | B37 | 3 | REPVTKAEML |
| SEQ ID NO: 295 | Cw7 | 41 | EGDCAPEEK |
| SEQ ID NO: 296 | Cw16 | 7 | ISGGPRISY |
| SEQ ID NO: 297 | DR13 | 19 | LLKYRAREPVTKAE |

MAGE-A9

| SEQ ID NO: 298 | A2 | 44 | ALSVMGVYV |

MAGE-A10

| SEQ ID NO: 299 | A2 | 44 | GLYDGMEHLI |
| SEQ ID NO: 300 | B53 | 2 | DPARYEFLW |

MAGE-A1 m

| SEQ ID NO: 301 | A2g | 44 | FLWGPRALVe |
| SEQ ID NO: 302 | Cw7 | 41 | VRIGHLYIL |
| SEQ ID NO: 303 | Cw7 | 41 | EGDCAPEEK |
| SEQ ID NO: 304 | DP4 | 75 | REPFTKAEMLGSVIR |
| SEQ ID NO: 305 | DR13 | 19 | AELVHFLLLKYRAR |

MAGE-C1

| SEQ ID NO: 306 | A2 | 44 | ILFGISLREV |
| SEQ ID NO: 307 | A2 | 44 | KVVEFLAML |
| SEQ ID NO: 308 | DQ6 | 63 | SSALLSIFQSSPE |
| SEQ ID NO: 309 | DQ6 | 63 | SFSYTLLSL |
| SEQ ID NO: 310 | DR15 | 20 | VSSFFSYTL |

MAGE-C2

| SEQ ID NO: 311 | A2 | 44 | LLFGLALIEV |
| SEQ ID NO: 312 | A2 | 44 | ALKDVEERV |
| SEQ ID NO: 313 | B44 | 21 | SESIKKKVL |
| SEQ ID NO: 314 | B57 | 8 | ASSTLYLVF |
| SEQ ID NO: 315 | DR15 | 20 | SSTLYLVFSPSSFST | mucink

| SEQ ID NO: 316 | | | PDTRPAPGSTAPPAHGVTSA |

NA88-A

| SEQ ID NO: 317 | B13 | 6 | QGQHFLQKV |

NY-ESO-1/LAGE-2

| SEQ ID NO: 318 | A2 | 44 | SLLMWITQC |
| SEQ ID NO: 319 | A2 | 44 | MLMAQEALAFL |
| SEQ ID NO: 320 | A24 | 20 | YLAMPFATPME |
| SEQ ID NO: 321 | A31 | 5 | ASGPGGGAPR |
| SEQ ID NO: 322 | A31 | 5 | LAAQERRVPR |
| SEQ ID NO: 323 | A68 | 8 | TVSGNILTIR |
| SEQ ID NO: 324 | B7 | 17 | APRGPHGGAASGL |
| SEQ ID NO: 325 | B35 | 20 | MPFATPMEAEL |
| SEQ ID NO: 326 | B49 | | KEFTVSGNILTI |
| SEQ ID NO: 327 | B51 | 12 | MPFATPMEA |
| SEQ ID NO: 328 | B52 | 5 | FATPMEAEL |
| SEQ ID NO: 329 | C12 | 12 | FATPMEAELAR |
| SEQ ID NO: 330 | Cw3 | 17 | LAMPFATPM |
| SEQ ID NO: 331 | Cw6 | 18 | ARGPESRLL |
| SEQ ID NO: 332 | DP4 | 75 | SLLMWITQCFLPVF |
| SEQ ID NO: 333 | DP4 | 75 | LLEFYLAMPFATPMEAELARRSLAQ |
| SEQ ID NO: 333 | DR1 | 18 | LLEFYLAMPFATPMEAELARRSLAQ |
| SEQ ID NO: 334 | DR1 | 18 | EFYLAMPFATPM |
| SEQ ID NO: 335 | DR1 | 18 | PGVLLKEFTVSGNILTIRLTAADHR |
| SEQ ID NO: 336 | DR2 | 25 | RLLEFYLAMPFA |
| SEQ ID NO: 337 | DR3 | 21 | QGAMLAAQERRVPRAAEVPR |
| SEQ ID NO: 338 | DR4 | 24 | PFATPMEAELARR |
| SEQ ID NO: 339 | DR4 | 24 | PGVLLKEFTVSGNILTIRLT |
| SEQ ID NO: 340 | DR4 | 24 | VLLKEFTVSG |
| SEQ ID NO: 341 | DR4 | 24 | AADHRQLQLSISSCLQQL |
| SEQ ID NO: 342 | DR4 | 24 | LLEFYLAMPFATPMEAELARRSLAQ |
| SEQ ID NO: 343 | DR52b | 25 | LKEFTVSGNILTIRL |
| SEQ ID NO: 344 | DR7 | 25 | PGVLLKEFTVSGNILTIRLTAADHR |
| SEQ ID NO: 342 | DR7 | 25 | LLEFYLAMPFATPMEAELARRSLAQ |
| SEQ ID NO: 345 | DR8 | 4 | KEFTVSGNILT |
| SEQ ID NO: 346 | DR9 | 3 | LLEFYLAMPFATPM |
| SEQ ID NO: 347 | DR15 | 20 | AGATGGRGPRGAGA |

SAGE

| SEQ ID NO: 348 | A24 | 20 | LYATVIHDI |

Sp17

| SEQ ID NO: 349 | A1 | 26 | ILDSSEEDK |

SSX-2

| SEQ ID NO: 350 | A2 | 44 | KASEKIFYV |
| SEQ ID NO: 351 | DP1 | 14 | EKIQKAFDDIAKYFSK |
| SEQ ID NO: 352 | DR1 | 18 | FGRLQGISPKI |
| SEQ ID NO: 353 | DR3 | 21 | WEKMKASEKIFYVYMKRK |
| SEQ ID NO: 354 | DR4 | 24 | KIFYVYMKRKYEAMT |
| SEQ ID NO: 355 | DR11 | 25 | KIFYVYMKRKYEAM |

SSX-4

| SEQ ID NO: 356 | DP10 | 2 | INKTSGPKRGKHAWTHRLRE |
| SEQ ID NO: 357 | DR3 | 21 | YFSKKEWEKMKSSEKIVYVY |
| SEQ ID NO: 358 | DR8 | 4 | MKLNYEVMTKLGFKVTLPPF |
| SEQ ID NO: 359 | DR8 | 4 | KHAWTHRLRERKQLVVYEEI |
| SEQ ID NO: 360 | DR11 | 25 | LGFKVTLPPFMRSKRAADFH |
| SEQ ID NO: 361 | DR15 | 20 | KSSEKIVYVYMKLNYEVMTK |
| SEQ ID NO: 362 | DR52 | 41 | KHAWTHRLRERKQLVVYEEI |

TAG-1

| SEQ ID NO: 363 | A2 | 44 | SLGWLFLLL |
| SEQ ID NO: 364 | B8 | 14 | LSRLSNRLL |

TAG-2

| SEQ ID NO: 364 | B8 | 14 | LSRLSNRLL |

TABLE 27-continued

Selected Tumor Associated Antigens

TRAG-3

| | | |
|---|---|---|
| SEQ ID NO: 365 DR1 | 18 | CEFHACWPAFTVLGE |
| SEQ ID NO: 365 DR4 | 24 | CEFHACWPAFTVLGE |
| SEQ ID NO: 366 DR7 | 25 | CEFHACWPAFTVLGE |

TRP2-INT2g

| | | |
|---|---|---|
| SEQ ID NO: 367 A68 | 8 | EVISCKLIKR |

XAGE-1b/GAGED2a

| | | |
|---|---|---|
| SEQ ID NO: 368 A2 | 44 | RQKKIRIQL |
| SEQ ID NO: 369 DR4 | 24 | HLGSRQKKIRIQLRSQ |
| SEQ ID NO: 370 DR9 | 3 | CATWKVICKSCISQTPG |

TABLE 28

Selected Differentiation antigens

| Gene/protein | Tumor | Peptide |
|---|---|---|
| CEA | gut carcinoma | |
| SEQ ID NO: 371 | | YLSGANLNLg |
| SEQ ID NO: 372 | | IMIGVLVGV |
| SEQ ID NO: 373 | | GVLVGVALI |
| SEQ ID NO: 374 | | HLFGYSWYK |
| SEQ ID NO: 375 | | QYSWFVNGTF |
| SEQ ID NO: 376 | | TYACFVSNL |
| SEQ ID NO: 377 | | AYVCGIQNSVSANRS |
| SEQ ID NO: 378 | | DTGFYTLHVIKSDLVNEEATGQFRV |
| SEQ ID NO: 379 | | YSWRINGIPQQHTQV |
| SEQ ID NO: 380 | | TYYRPGVNLSLSC |
| SEQ ID NO: 381 | | EIIYPNASLLIQN |
| SEQ ID NO: 382 | | YACFVSNLATGRNNS |
| SEQ ID NO: 383 | | LWWVNNQSLPVSP |
| SEQ ID NO: 383 | | LWWVNNQSLPVSP |
| SEQ ID NO: 383 | | LWWVNNQSLPVSP |
| SEQ ID NO: 384 | | EIIYPNASLLIQN |
| SEQ ID NO: 385 | | NSIVKSITVSASG |
| gp100/Pmel17 | melanoma | |
| SEQ ID NO: 386 | | KTWGQYWQV |
| SEQ ID NO: 387 | | (A)MLGTHTMEV |
| SEQ ID NO: 388 | | ITDQVPFSV |
| SEQ ID NO: 389 | | YLEPGPVTA |
| SEQ ID NO: 390 | | LLDGTATLRL |
| SEQ ID NO: 391 | | VLYRYGSFSV |
| SEQ ID NO: 392 | | SLADTNSLAV |
| SEQ ID NO: 393 | | RLMKQDFSV |
| SEQ ID NO: 394 | | RLPRIFCSC |
| SEQ ID NO: 395 | | LIYRRRLMK |
| SEQ ID NO: 396 | | ALLAVGATK |
| SEQ ID NO: 397 | | IALNFPGSQK |
| SEQ ID NO: 398 | | RSYVPLAHR |
| SEQ ID NO: 399 | | ALNFPGSQK |
| SEQ ID NO: 399 | | ALNFPGSQK |
| SEQ ID NO: 400 | | VYFFLPDHL |
| SEQ ID NO: 401 | | RTKQLYPEW |
| SEQ ID NO: 402 | | HTMEVTVYHR |
| SEQ ID NO: 403 | | SSPGCQPPA |
| SEQ ID NO: 404 | | VPLDCVLYRY |
| SEQ ID NO: 405 | | LPHSSSHWL |
| SEQ ID NO: 406 | | SNDGPTLI |
| SEQ ID NO: 407 | | GRAMLGTHTMEVTVY |
| SEQ ID NO: 408 | | WNRQLYPEWTEAQRLD |
| SEQ ID NO: 409 | | TTEWVETTARELPIPEPE |
| SEQ ID NO: 410 | | TGRAMLGTHTMEVTVYH |
| SEQ ID NO: 407 | | GRAMLGTHTMEVTVY |
| mammaglobin-A | breast cancer | PLLENVISK |
| SEQ ID NO: 411 | | |
| Melan-A/MART-1 | melanoma | |
| SEQ ID NO: 408 | | (E)AAGIGILTV |
| SEQ ID NO: 409 | | ILTVILGVL |
| SEQ ID NO: 408 | | EAAGIGILTV |
| SEQ ID NO: 410 | | AEEAAGIGIL(T) |
| SEQ ID NO: 411 | | RNGYRALMDKS |
| SEQ ID NO: 412 | | YTTAEEAAGIGILTVILGVLLLIGCWYCRR |
| SEQ ID NO: 408 | | EEAAGIGILTVI |
| SEQ ID NO: 413 | | AAGIGILTVILGVL |

TABLE 28-continued

Selected Differentiation antigens

| Gene/protein | Tumor | Peptide |
|---|---|---|
| SEQ ID NO: 414 | | APPAYEKLpSAEQf |
| SEQ ID NO: 408 | | EEAAGIGILTVI |
| SEQ ID NO: 415 | | RNGYRALMDKSLHVGTQCALTRR |
| SEQ ID NO: 416 | | MPREDAHFIYGYPKKGHGHS |
| SEQ ID NO: 417 | | KNCEPVVPNAPPAYEKLSAE |
| NY-BR-1 SEQ ID NO: 418 | breast cancer | SLSKILDTV |
| OA1 SEQ ID NO: 419 | melanoma | LYSACFWWL |
| PAP | prostate cancer | |
| SEQ ID NO: 420 | | FLFLLFFWL |
| SEQ ID NO: 421 | | TLMSAMTNL |
| SEQ ID NO: 422 | | ALDVYNGLL |
| PSA | prostate carcinoma | |
| SEQ ID NO: 423 | | FLTPKKLQCV |
| SEQ ID NO: 424 | | VISNDVCAQV |
| RAB38/NY-MEL-1 SEQ ID NO: 425 | melanoma | VLHWDPETV |
| TRP-1/gp75 | melanoma | |
| SEQ ID NO: 426 | | MSLQRQFLR |
| SEQ ID NO: 427 | | ISPNSVFSQWRVVCDSLEDYD |
| SEQ ID NO: 428 | | SLPYWNFATG |
| SEQ ID NO: 429 | | SQWRVVCDSLEDYDT |
| TRP-2 | melanoma | |
| SEQ ID NO: 430 | | SVYDFFVWL |
| SEQ ID NO: 431 | | TLDSQVMSL |
| SEQ ID NO: 432 | | LLGPGRPYR |
| SEQ ID NO: 432 | | LLGPGRPYR |
| SEQ ID NO: 433 | | ANDPIFVVL |
| SEQ ID NO: 434 | | QCTEVRADTRPWSGP |
| SEQ ID NO: 435 | | ALPYWNFATG |
| tyrosinase | melanoma | |
| SEQ ID NO: 436 | | KCDICTDEY |
| SEQ ID NO: 437 | | SSDYVIPIGTY |
| SEQ ID NO: 438 | | MLLAVLYCL |
| SEQ ID NO: 439 | | CLLWSFQTSA |
| SEQ ID NO: 440 | | YMDGTMSQV |
| SEQ ID NO: 441 | | AFLPWHRLF |
| SEQ ID NO: 442 | | IYMDGTADFSF |
| SEQ ID NO: 443 | | QCSGNFMGF |
| SEQ ID NO: 444 | | TPRLPSSADVEF |
| SEQ ID NO: 445 | | LPSSADVEF |
| SEQ ID NO: 446 | | LHHAFVDSIF |
| SEQ ID NO: 447 | | SEIWRDIDFd |
| SEQ ID NO: 448 | | QNILLSNAPLGPQFP |
| SEQ ID NO: 449 | | SYLQDSDPDSFQD |
| SEQ ID NO: 450 | | FLLHHAFVDSIFEQWLQRHRP |

TABLE 29

Select Tumor Associated Antigens

| ene | Normal tissue expression | Peptide |
|---|---|---|
| adipophilin SEQ ID NO: 451 | adipocytes, macrophages | SVASTITGV |
| AIM-2 SEQ ID NO: 452 | ubiquitous (low level) | RSDSGQQARY |
| ALDH1A1 SEQ ID NO: 453 | mucosa, keratinocytes | LLYKLADLI |
| BCLX (L) SEQ ID NO: 454 | ubiquitous (low level) | YLNDHLEPWI |
| BING-4 SEQ ID NO: 455 | ubiquitous (low level) | CQWGRLWQL |
| CALCA SEQ ID NO: 456 | thyroid | VLLQAGSLHA |

TABLE 29-continued

Select Tumor Associated Antigens

| Gene | Normal tissue expression | Peptide |
|---|---|---|
| CD45 SEQ ID NO: 457 | proliferating cells, testis, multiple tissues (low level) | KFLDALISL |
| CD274 SEQ ID NO: 458 | multiple tissues (lung, heart, dendritic cell) and induced by IFN-γ | LLNAFTVTV |
| CPSF SEQ ID NO: 459 SEQ ID NO: 460 | ubiquitous (low level) | KVHPVIWSL LMLQNALTTM |
| cyclin D1 SEQ ID NO: 461 SEQ ID NO: 462 | ubiquitous (low level) | LLGATCMFV NPPSMVAAGSVVAAV |
| DKK1 SEQ ID NO: 463 | testis, prostate, mesenchymal stem cells | ALGGHPLLGV |
| ENAH (hMena) SEQ ID NO: 464 | breast, prostate stroma and epithelium of colon-rectum, pancreas, endometrium | TMNGSKSPV |
| EpCAM SEQ ID NO: 465 | epithelial cells | RYQLDPKFI |
| EphA3 SEQ ID NO: 466 | many | DVTFNIICKKCG |
| EZH2 SEQ ID NO: 467 | ubiquitous (low level) | FMVEDETVL FINDEIFVEL KYDCFLHPF KYVGIEREM |
| FGF5 SEQ ID NO: 468 | brain, kidney | NTYASPRFKf |
| glypican-3 SEQ ID NO: 469 | placental and multiple tissues | FVGEFFTDV EYILSLEEL |
| G250/MN/CAIX SEQ ID NO: 470 | stomach, liver, pancreas | HLSTAFARV |
| HER-2/neu SEQ ID NO: 471 SEQ ID NO: 472 SEQ ID NO: 473 SEQ ID NO: 474 SEQ ID NO: 475 SEQ ID NO: 476 SEQ ID NO: 477 SEQ ID NO: 478 SEQ ID NO: 479 SEQ ID NO: 480 SEQ ID NO: 481 SEQ ID NO: 482 SEQ ID NO: 483 SEQ ID NO: 484 SEQ ID NO: 485 | ubiquitous (low level) | KIFGSLAFL IISAVVGIL ALCRWGLLL ILHNGAYSL RLLQETELV VVLGVVFGI YMIMVKCWMI HLYQGCQVV YLVPQQGFFC PLQPEQLQV TLEEITGYL ALIHHNTHL PLTSIISAV VLRENTSPK TYLPTNASL |
| HLA-DOB SEQ ID NO: 486 | B lymphocytes, monocytes, blood cells, adrenals | FLLGLIFLL |
| Hepsin SEQ ID NO: 487 SEQ ID NO: 488 | kidney, liver, skin, | SLLSGDWVL GLQLGVQAV |
| SEQ ID NO: 489 | | PLTEYIQPV |
| IDO1 SEQ ID NO: 490 | lymph nodes, placenta, and many cell types in the course of inflammatory response | ALLEIASCL |
| IGF2B3 SEQ ID NO: 491 SEQ ID NO: 492 | ubiquitous (low level) | NLSSAEVVV RLLVPTQFV |
| IL13Ralpha2 SEQ ID NO: 493 | | WLPFGFILI |
| Intestinal carboxyl esterase SEQ ID NO: 494 | liver, intestine, kidney | SPRWWPTCL |
| alpha-foetoprotein SEQ ID NO: 495 SEQ ID NO: 496 SEQ ID NO: 497 | liver | GVALQTMKQ FMNKFIYEI QLAVSVILRV |
| Kallikrein 4 SEQ ID NO: 498 SEQ ID NO: 499 SEQ ID NO: 500 SEQ ID NO: 501 | prostate and ovarian cancer cancer | FLGYLILGV SVSESDTIRSISIAS LLANGRMPTVLQCVN RMPTVLQCVNVSVVS |
| KIF20A SEQ ID NO: 502 SEQ ID NO: 503 SEQ ID NO: 504 | ubiquitous (low level) | LLSDDDVVV AQPDTAPLPV CIAEQYHTV |
| Lengsin SEQ ID NO: 505 | eye lens and low level in multiple tissues | FLPEFGISSA |
| M-CSF SEQ ID NO: 506 | liver, kidney | LPAVVGLSPGEQEY |
| MCSP SEQ ID NO: 507 | endothelial cells, chondrocytes, smooth muscle cells | VGQDVSVLFRVTGALQ |
| mdm-2 SEQ ID NO: 508 | ubiquitous (brain, muscle, lung) | VLFYLGQY |
| Meloe SEQ ID NO: 509 SEQ ID NO: 510 SEQ ID NO: 511 SEQ ID NO: 512 SEQ ID NO: 513 | ubiquitous (low level) | TLNDECWPA ERISSTLNDECWPA FGRLQGISPKI TSREQFLPSEGAA CPPWHPSERISSTL |
| Midkine SEQ ID NO: 514 SEQ ID NO: 515 SEQ ID NO: 516 | ubiquitous (low level) | ALLALTSAV AQCQETIRV LTLLALLALTSAVAK |
| MMP-2 SEQ ID NO: 517 | ubiquitous | GLPPDVQRVh |
| MMP-7 SEQ ID NO: 518 | ubiquitous (low level) | SLFPNSPKWTSK |
| MUC1 SEQ ID NO: 519 SEQ ID NO: 520 | glandular epithelia | STAPPVHNV LLLLTVLTV |

TABLE 29-continued

Select Tumor Associated Antigens

| ene | Normal tissue expression | Peptide |
|---|---|---|
| SEQ ID NO: 521 | | PGSTAPPAHGVT |
| MUC5AC SEQ ID NO: 522 | surface mucosal cells, respiratory tract, and stomach epithelia | TCQPTCRSL |
| p53 SEQ ID NO: 523 SEQ ID NO: 524 SEQ ID NO: 525 SEQ ID NO: 526 SEQ ID NO: 527 | ubiquitous (low level) | LLGRNSFEV RMPEAAPPV SQKTYQGSY PGTRVRAMAIYKQ HLIRVEGNLRVE |
| PAX5 SEQ ID NO: 528 | hemopoietic system | TLPGYPPHV |
| PBF SEQ ID NO: 529 | ovary, pancreas, spleen, liver | CTACRWKKACQR |
| PRAME SEQ ID NO: 530 SEQ ID NO: 531 SEQ ID NO: 532 SEQ ID NO: 533 SEQ ID NO: 534 | testis, ovary, endometrium, adrenals | VLDGLDVLL SLYSFPEPEA ALYVDSLFFL SLLQHLIGL LYVDSLFFLc |
| PSMA SEQ ID NO: 535 | prostate, CNS, liver | NYARTEDFF |
| RAGE-1 SEQ ID NO: 536 SEQ ID NO: 537 SEQ ID NO: 538 | retina | LKLSGVVRL PLPPARNGGLg SPSSNRIRNT |
| RGS5 SEQ ID NO: 539 SEQ ID NO: 540 | heart, skeletal muscle, pericytes | LAALPHSCL GLASFKSFLK |
| RhoC SEQ ID NO: 541 | ubiquitous (low level) | RAGLQVRKNK |
| RNF43 SEQ ID NO: 542 SEQ ID NO: 543 | | ALWPWLLMA(T) NSQPVWLCL |
| RU2AS SEQ ID NO: 544 | testis, kidney, bladder | LPRWPPPQL |
| secernin 1 SEQ ID NO: 545 | ubiquitous | KMDAEHPEL |
| SOX10 SEQ ID NO: 546 SEQ ID NO: 547 | ubiquitous (low level) | AWISKPPGV SAWISKPPGV |
| STEAP1 SEQ ID NO: 548 SEQ ID NO: 549 | prostate | MIAVFLPIV HQQYFYKIPILVINK |
| survivin SEQ ID NO: 550 SEQ ID NO: 551 | ubiquitous ubiquitous | ELTLGEFLKL TLGEFLKLDRERAKN |
| Telomerase SEQ ID NO: 552 SEQ ID NO: 553 SEQ ID NO: 554 SEQ ID NO: 555 | testis, thymus, bone marrow, lymph nodes | ILAKFLHWLe RLVDDFLLV RPGLLGASVLGLDDI LTDLQPYMRQFVAHL |
| TPBG SEQ ID NO: 556 | multiple tissues (esophagus, bladder) | RLARLALVL |
| VEGF SEQ ID NO: 557 | ubiquitous (low level) | SRFGGAVVR |
| WT1 SEQ ID NO: 558 SEQ ID NO: 559 SEQ ID NO: 560 SEQ ID NO: 561 SEQ ID NO: 561 | testis, ovary, bone marrow spleen | TSEKRPFMCAY CMTWNQMNL LSHLQMHSRKH KRYFKLSHLQMHSRKH KRYFKLSHLQMHSRKH |

TABLE 30

Selected Cancer Testis Antigens

| Gene family | Family member |
|---|---|
| MAGEA | MAGEA1 |
| MAGEA | MAGEA2 |
| MAGEA | MAGEA3 |
| MAGEA | MAGEA4 |
| MAGEA | MAGEA5 |
| MAGEA | MAGEA6 |
| MAGEA | MAGEA8 |
| MAGEA | MAGEA9 |
| MAGEA | MAGEA10 |
| MAGEA | MAGEA11 |
| MAGEA | MAGEA12 |
| BAGE | BAGE |
| BAGE | BAGE2 |
| BAGE | BAGE3 |
| BAGE | BAGE4 |
| BAGE | BAGE5 |
| MAGEB | MAGEB1 |
| MAGEB | MAGEB2 |
| MAGEB | MAGEB5 |
| MAGEB | MAGEB6 |
| MAGEB | MAGEB3 |
| MAGEB | MAGEB4 |
| GAGE | GAGE1 |
| GAGE | GAGE2A |
| GAGE | GAGE3 |
| GAGE | GAGE4 |
| GAGE | GAGE5 |
| GAGE | GAGE6 |
| GAGE | GAGE7 |
| GAGE | GAGE8 |
| SSX | SSX1 |
| SSX | SSX2 |
| SSX | SSX2b |
| SSX | SSX3 |
| SSX | SSX4 |
| NY-ESO-1 | CTAG1B |
| NY-ESO-1 | LAGE-1b |
| NY-ESO-1 | CTAG2 |
| MAGEC1 | MAGEC1 |
| MAGEC1 | MAGEC3 |
| SYCP1 | SYCP1 |
| BRDT | BRDT |
| MAGEC2 | MAGEC2 |
| SPANX | SPANXA1 |
| SPANX | SPANXB1 |
| SPANX | SPANXC |
| SPANX | SPANXD |
| SPANX | SPANXN1 |
| SPANX | SPANXN2 |
| SPANX | SPANXN3 |
| SPANX | SPANXN4 |
| SPANX | SPANXN5 |
| XAGE | XAGE1D |
| XAGE | XAGE1C |
| XAGE | XAGE1B |
| XAGE | XAGE1 |

TABLE 30-continued

Selected Cancer Testis Antigens

| Gene family | Family member |
| --- | --- |
| XAGE | XAGE2 |
| XAGE | XAGE3 |
| XAGE | XAGE-3b |
| XAGE | XAGE-4/RP11-167P23.2 |
| XAGE | XAGE5 |
| HAGE | DDX43 |
| SAGE | SAGE1 |
| ADAM2 | ADAM2 |
| PAGE-5 | PAGE5 |
| PAGE-5 | CT16.2 |
| PAGE-5 | PAGE1 |
| PAGE-5 | PAGE2 |
| PAGE-5 | PAGE2B |
| PAGE-5 | PAGE3 |
| PAGE-5 | PAGE4 |
| LIPI | LIPI |
| NA88A pseudogene | VENTXP1 |
| IL13RA | IL13RA2 |
| TSP50 | TSP50 |
| CTAGE-1 | CTAGE1 |
| CTAGE-1 | CTAGE-2 |
| CTAGE-1 | CTAGE5 |
| SPA17 | SPA17 |
| ACRBP | ACRBP |
| CSAGE | CSAG1 |
| CSAGE | CSAG2 |
| MMA1 | DSCR8 |
| MMA1 | MMA1b |
| CAGE | DDX53 |
| BORIS | CTCFL |
| HOM-TES-85 | LUZP4 |
| AF15q14 | CASC5 |
| HCA661 | TFDP3 |
| JARID1B | JARID1B |
| LDHC | LDHC |
| MORC | MORC1 |
| SGY-1 | DKKL1 |
| SPO11 | SPO11 |
| TPX1 | CRISP2 |
| NY-SAR-35 | FMR1NB |
| FTHL17 | FTHL17 |
| NXF2 | NXF2 |
| TAF7L | TAF7L |
| TDRD1 | TDRD1 |
| TDRD1 | TDRD6 |
| TDRD | TDRD4 |
| TEX15 | TEX15 |
| FATE | FATE1 |
| TPTE | TPTE |
| CT45 | CT45A1 |
| CT45 | CT45A2 |
| CT45 | CT45A3 |
| CT45 | CT45A4 |
| CT45 | CT45A5 |
| CT45 | CT45A6 |
| HORMAD1 | HORMAD1 |
| HORMAD | HORMAD2 |
| CT47 | CT47A1 |
| CT47 | CT47A2 |
| CT47 | CT47A3 |
| CT47 | CT47A4 |
| CT47 | CT47A5 |
| CT47 | CT47A6 |
| CT47 | CT47A7 |
| CT47 | CT47A8 |
| CT47 | CT47A9 |
| CT47 | CT47A10 |
| CT47 | CT47A11 |
| CT47 | CT47B1 |
| SLCO6A1 | SLCO6A1 |
| TAG | TAG |
| LEMD1 | LEMD1 |
| HSPB9 | HSPB9 |
| CCDC110 | CCDC110 |
| ZNF165 | ZNF165 |
| SPACA3 | SPACA3 |
| CXorf48 | CXorf48 |
| THEG | THEG |
| ACTL8 | ACTL8 |
| NLRP4 | NLRP4 |
| COX6B2 | COX6B2 |
| LOC348120 | LOC348120 |
| CCDC33 | CCDC33 |
| LOC196993 | LOC196993 |
| PASD1 | PASD1 |
| LOC647107 | LOC647107 |
| TULP2 | TULP2 |
| CT66 | CT66/AA884595 |
| PRSS54 | PRSS54 |
| RBM46 | RBM46 |
| CT69 | CT69/BC040308 |
| CT70 | CT70/BI818097 |
| SPINLW1 | SPINLW1 |
| TSSK6 | TSSK6 |
| ADAM29 | ADAM29 |
| CCDC36 | CCDC36 |
| LOC440934 | LOC440934 |
| SYCE1 | SYCE1 |
| CPXCR1 | CPXCR1 |
| TSPY1 | TSPY3 |
| TSGA10 | TSGA10 |
| PIWIL | HIWI, MIWI, PIWI |
| PIWIL | PIWIL2 |
| ARMC3 | ARMC3 |
| AKAP3 | AKAP3 |
| Cxorf61 | Cxorf61 |
| PBK | PBK |
| C21orf99 | C21orf99 |
| OIP5 | OIP5 |
| CEP290 | CEP290 |
| CABYR | CABYR |
| SPAG9 | SPAG9 |
| MPHOSPH1 | MPHOSPH1 |
| ROPN1 | ROPN1 |
| PLAC1 | PLAC1 |
| CALR3 | CALR3 |
| PRM | PRM1 |
| PRM | PRM2 |
| CAGE1 | CAGE1 |
| CT96 | TTK |
| LY6K | LY6K |
| IMP-3 | IMP-3 |
| AKAP4 | AKAP4 |
| DPPA2 | DPPA2 |
| KIAA0100/MLAA-22 | KIAA0100 |
| DCAF12 | DCAF12 |
| SEMG1 | SEMG1 |
| POTE | POTED |
| POTE | POTEE |
| POTE | POTEA |
| POTE | POTEG |
| POTE | POTEB |
| POTE | POTEC |
| POTE | POTEH |
| GOLGAGL2 FA | GOLGAGL2 FA |
| NUF2/CDCA1 | CDCA1 |
| RHOXF2/PEPP2 | PEPP2 |
| OTOA | OTOA |
| CCDC62 | CCDC62 |
| GPATCH2 | GPATCH2 |
| CEP55 | CEP55 |
| FAM46D | FAM46D |
| TEX14 | TEX14 |
| CTNNA2 | CTNNA2 |
| FAM133A | FAM133A |
| LYPD6B | LOC130576 |
| ANKRD45 | ANKRD45 |
| ELOVL4 | ELOVL4 |
| IGSF11 | IGSF11 |
| TMEFF | TMEFF1 |
| TMEFF | TMEFF2 |
| ARX | ARX |

TABLE 30-continued

Selected Cancer Testis Antigens

| Gene family | Family member |
|---|---|
| SPEF2 | SPEF2 |
| GPAT2 | GPAT2 |
| TMEM108 | TMEM108 |
| NOL4 | NOL4 |
| PTPN20A | PTPN20A |
| SPAG4 | SPAG4 |
| MAEL | MAEL |
| RQCD1 | RQCD1 |
| PRAME | PRAME |
| TEX101 | TEX101 |
| SPATA19 | SPATA19 |
| ODF1 | ODF1 |
| ODF2 | ODF2 |
| ODF3 | ODF3 |
| ODF4 | ODF4 |
| ATAD2 | ATAD2 |
| ZNF645 | ZNF645 |
| KIF2C | MCAK |
| SPAG1 | SPAG1 |
| SPAG6 | SPAG6 |
| SPAG8 | SPAG8 |
| SPAG17 | SPAG17 |
| FBXO39 | FBXO39 |
| RGS22 | RGS22 |
| cylin A | cyclin A1 |
| KP-OVA52 | C15orf60 |
| CCDC83 | CCDC83 |
| TEKT | TEKT5 |
| NR6A1 | NR6A1 |
| TMPRSS12 | TMPRSS12 |
| TPPP2 | TPPP2 |
| PRSS55 | PRSS55 |
| DMRT1 | DMRT1 |
| HEMGN | EDAG, NDR |
| DNAJB8 | DNAJB8 |
| CSAGE | CSAG3B |
| NY-ESO-1 | CTAG1A |
| GAGE | GAGE12B |
| GAGE | GAGE12C |
| GAGE | GAGE12D |
| GAGE | GAGE12E |
| GAGE | GAGE12F |
| GAGE | GAGE12G |
| GAGE | GAGE12H |
| GAGE | GAGE12I |
| GAGE | GAGE12J |
| GAGE | GAGE13 |
| TSPY1 | LOC728137 |
| MAGEA | MAGEA2B |
| MAGEA | MAGEA9B/LOC728269 |
| NXF2 | NXF2B |
| SPANX | SPANXA2 |
| SPANX | SPANXB2 |
| SPANX | SPANXE |
| SSX | SSX4B |
| SSX | SSX5 |
| SSX | SSX6 |
| SSX | SSX7 |
| SSX | SSX9 |
| TSPY1 | TSPY1D |
| TSPY1 | TSPY1E |
| TSPY1 | TSPY1F |
| TSPY1 | TSPY1G |
| TSPY1 | TSPY1H |
| TSPY1 | TSPY1I |
| TSPY1 | TSPY2 |
| XAGE | XAGE1E |
| XAGE | XAGE2B/CTD-2267G17.3 |

TABLE 31

| Tumor antigen | Tumor source |
|---|---|
| Alphafetoprotein (AFP) | Germ cell tumors |
| | Hepatocellular carcinoma |
| Carcinoembryonic antigen (CEA) | bowel cancers |
| CA-125 | Ovarian cancer |
| MUC-1 | breast cancer |
| Epithelial tumor antigen (ETA) | Breast cancer |
| Tyrosinase | Malignant melanoma |
| Melanoma-associated antigen (MAGE) | malignant melanoma |
| abnormal products of ras, p53 | Various tumors |

TABLE 32

General Categories and Examples of Tumor Antigens

| Category | Example Antigen | Cancer Histology |
|---|---|---|
| Oncofetal | CEA | Colorectal carcinoma |
| | Immature laminin receptor | RCC |
| | TAG-72 | Prostate carcinoma |
| Oncoviral | HPV E6, E7 | Cervical carcinoma |
| Overexpressed/ | BING-4 | Melanoma |
| accumulated | Calcium-activated chloride channel 2 | Lung carcinoma |
| | Cyclin-B$_1$ | Multi |
| | 9D7 | RCC |
| | Ep-CAM | Breast carcinoma |
| | EphA3 | Multi |
| | Her2/neu | Multi |
| | Telomerase | Multi |
| | Mesothelin | Ductal pancreatic carcinoma |
| | SAP-1 | Colorectal carcinoma |
| | Survivin | Multi |
| Cancer-Testis | BAGE family | Multi |
| | CAGE family | Multi |
| | GAGE family | Multi |
| | MAGE family | Multi |
| | SAGE family | Multi |
| | XAGE family | Multi |
| CT9, CT10 | | Multi |
| | NY-ESO-1/LAGE-1 | Multi |
| | PRAME | Multi |
| | SSX-2 | Melanoma, Multi |
| Lineage | Melan-A/MART-1 | Melanoma |
| Restricted | Gp100/pmel17 | Melanoma |
| | Tyrosinase | Melanoma |
| | TRP-1/-2 | Melanoma |
| | P. polypeptide | Melanoma |
| | MC1R | Melanoma |
| | Prostate-specific antigen | Prostate |
| Mutated | β-catenin | Melanoma, Prostate, HCC |
| | BRCA1/2 | Breast, ovarian carcinoma |
| | CDK4 | Multi |
| | CML66 | CML |
| | Fibronectin | Multi |
| | MART-2 | Melanoma |
| | p53 | Multi |
| | Ras | Multi |
| | TGF-βRII | Colorectal carcinoma |
| Posttransla- | MUC1 | Ductal carcinoma, RCC |
| tionally altered | | |
| Idiotypic | Ig, TCR | B, T leukemia, lymphoma, myeloma |

In some embodiments, the sequence is at least about 80%, at least about 85%, at least about 90%, at least about 95%, or at least about 99% homologous to the sequence of any one of SEQ ID NOs: 160-561.

It is now generally understood that cancer vaccines that are designed to elicit strong immune responses require a fully personalized approach. With the advent of high throughput genome and exome sequencing technologies, it has become possible to identify the entire mutanome from the primary tumor and metastases of a patient. As a result, personalized vaccine compositions can be developed, based on specific antigens found the patient's tumor (Hacohen et al., Cancer Immunol Res. 2013 July; 1(1): 11-15. Getting Personal with Neoantigen-Based Therapeutic Cancer Vaccines). These tumor-specific antigens derived from mutated proteins ("neoantigens") that are present only in this tumor, provide highly specific targets for antitumor immunity.

In addition to delivery of cancer vaccines as peptides, nucleic acid—based cancer vaccines (NAVs), including DNA- and mRNA-based vaccines, have emerged as an advantageous option. In particular RNA, which, unlike DNA, only needs to gain entry into the cytoplasm, where translation occurs, has been the subject of a number of studies in mice and humans. Moreover, RNA has the additional advantage of acting as an adjuvant, since it strongly stimulates the host's innate defense system, through the activation of the TLR3 and 7/8 pathways, which recognize double- and single-stranded RNA, respectively, resulting in inflammatory activation and the generation of type 1 interferon.

The first successful mRNA cancer vaccine was developed by Conry et al., who showed that mice immunized with mRNA coding for carcinoembryonic antigen (CEA) mounted an anti-CEA antibody response when challenged with CEA expressing tumor cells R. M. Conry, A. F. LoBuglio, M. Wright et al., "Characterization of a messenger RNA polynucleotide vaccine vector," Cancer Research, vol. 55, no. 7, pp. 1397-1400, 1995. Since then improvements to constructs and delivery have been subject of intensive study. Nucleic acid based vaccines, including RNA based vaccine constructs have been generated, which can express a number of antigens on a single nucleotide, including a combination of neoantigens and/or tumor-associated antigens. Fast manufacture of RNA allows the flexibility needed for personalize approaches.

Once an IVT mRNA transcript has been constructed (using methods known in the art, including but not limited the addition of components needed for expression, e.g., 5' Cap, Poly(A) Tail, UTR, and Chemically Modified Nucleosides), it must be administered and ultimately must reach the cytoplasm of target cells. In general, nonviral delivery methods are preferred over viral vectors for their low cost, ease of large-scale production, and potential for improved safety (McNamara et al., Journal of Immunology Research Volume 2015 (2015), RNA-Based Vaccines in Cancer Immunotherapy). However, issues with the short half-life of naked mRNA vaccines due to RNAse-mediated degradation, as well as the short transient expression, which limits the time of effective treatment, still need to be addressed.

It is contemplated that the genetically engineered bacteria or viruses of the invention can continue to express and deliver the RNA, thereby providing a more sustained delivery than the conventional "naked RNA" delivery. In addition, the ability to manufacture the genetically engineered bacteria or OVs quickly with help enable more personalized approaches.

Alternatively, when used in combination, the RNA vaccine can be delivered in liposomes or other carriers known in the art to increase stability.

In addition, mRNA transfected dendritic cell (DC) vaccines represent a distinct type of vaccine strategy involving RNA. When used as a vaccination platform, dendritic cells (DCs) are transfected with mRNA encoding a desired tumor antigen and then delivered to the host in order to elicit an immune response against the antigen of interest. DCs can be transfected with tumor associated antigen (TAA) mRNA or total tumor RNA (reviewed in McNamara et al.).

Other Immune Modulators

In some embodiments, the genetically engineered bacteria or genetically engineered oncolytic viruses are capable of producing an immune modulator that modulates M2 macrophage inducing cytokines and/or growth factors. In some embodiments, the genetically engineered bacteria or genetically engineered oncolytic viruses are capable of producing an immune modulator that inhibits M2 macrophage inducing cytokines and/or growth factors. In some embodiments, the genetically engineered bacteria or genetically engineered oncolytic viruses are capable of producing an immune modulator that modulates M1 macrophages. In some embodiments, the genetically engineered bacteria or genetically engineered oncolytic viruses are capable of producing an immune modulator that induces M1 macrophages.

In some embodiments, the genetically engineered bacteria or genetically engineered oncolytic viruses are capable of producing an immune modulator that modulates myeloid-derived suppressor cells (MDSC). In some embodiments, the genetically engineered bacteria or genetically engineered oncolytic viruses are capable of producing an immune modulator that inhibits MDSC function. In some embodiments, the genetically engineered bacteria or genetically engineered oncolytic viruses are capable of producing an immune modulator that modulates antigen presenting cell and Tcell interations. In some embodiments, the genetically engineered bacteria or genetically engineered oncolytic viruses are capable of producing an immune modulator that modulates CTUCD8+ Tcell inducing cytokines and/or growth factors. In some embodiments, the genetically engineered bacteria or genetically engineered oncolytic viruses are capable of producing an immune modulator that stimulates CTUCD8+ Tcell inducing cytokines and/or growth factors. In some embodiments, the genetically engineered bacteria or genetically engineered oncolytic viruses are capable of producing an immune modulator that modulates chemokines that attack immunosuppressive cells. In some embodiments, the genetically engineered bacteria or genetically engineered oncolytic viruses are capable of producing an immune modulator that stimulates chemokines that attack immunosuppressive cells. In some embodiments, the genetically engineered bacteria or genetically engineered oncolytic viruses are capable of producing an immune modulator such as any of those found in Table 33 below.

TABLE 33

Exemplary Immune Modulators
Immune Modulators

| Compound | Role |
| --- | --- |
| TLR agonists (TLR4, TLR7, TLR8, TLR9) | Dendritic Cell Activation |
| NLR agonists | |
| STING agonists | |
| INF-alpha/beta | |
| GM-CSF | |
| Antagonists of IL-4, IL-13, IL-10 | Block Induction of |
| M-CSF Antagonists | M2 Macrophage |
| GM-CSF | Induction of |
| Interferon-γ | M1 Macrophage |
| Inhibit Tryptophan Oxygenase (TDO) | Tryptophan and Kynurenine |
| Inhibit Tryptophan Pyrrolase (IDO) | Metabolism |

TABLE 33-continued

Exemplary Immune Modulators
Immune Modulators

| Compound | Role |
|---|---|
| Arginase | Block MDSC Mediated |
| Antagonists of ARG1/2, iNOS, PDE5 | T Cell Suppression |
| PD1/PDL1 antagonist | Immune Regulation |
| CD80/86 antagonist | |
| B7-H3/B7-H4 antagonist | |
| HVEM antagonist | |
| LAG3 antagonist | |
| CTLA4 antagonist | |
| TIM3 antagonist | |
| ICOS or ICOS agonist | |
| OX40 or OX40 agonist | |
| CD137 or CD137 agonist | |
| CD27 or CD27 agonist | |
| CD40 or CD40 agonist | |
| IL-7, IL-15, IL-21, IL-18, IL-2, IL-12, (Localized Delivery) | CTL/CD8+ T Cell Stimulation |
| CCL5, CXCL1, CXCL12, CCL2 (binding to CCR5, CXCR1, CXCR4, CCR2) | Modulate Immunosuppression |
| A2aR- Adenosine antagonist | Anti-Inflammatory Effects |
| cAMP antagonist | Protein Kinase Activator |

Other Anti-Cancer Molecules

In some embodiments, the genetically engineered bacteria are capable of producing cytotoxic, anti-neoplastic molecules. For example, the genetically engineered bacteria are capable of producing azurin, e.g., *P. aeruginosa* azurin, a bacterial redox protein that is capable of entering human cancer cells and inducing apoptosis (Bernardes et al., 2013; Zang et al., 2012). In some embodiments, the genetically engineered bacterium is a tumor-targeting bacterium that is capable of expressing azurin under the control of a promoter that is activated by low-oxygen conditions.

In alternate embodiments, the anti-cancer molecule is selected from a cytotoxic agent, Cly A, FASL, TRAIL, TNF-alpha, a cytokine, CCL21, IL-2, IL-18, LIGHT, an antigen, an antibody, a single-chain antibody, a CtxB-PSA fusion protein, a CPV-OmpA fusion protein, a NY-ESO-1 tumor antigen, RAF1, a single-chain HIF1-alpha antibody, a single-chain CTLA-4 antibody, a single-chain PD-1 antibody, endostatin, thrombospondin-1, TRAIL, SMAC, Stat3, Bcl2, FLT3L, GM-CSF, IL-12, AFP, VEGFR2, an enzyme, *E. coli* CD, and HSV-TK. In some embodiments, the genetically engineered bacteria of the invention are tumor-targeting bacteria comprising a gene encoding a single-chain HIF1-alpha antibody, and are capable of delivering the anti-cancer molecule specifically and locally to cancerous cells.

CD166, a member of the immunoglobulin superfamily and a ligand for the lymphocyte antigen CD6, mediates homophilic and heterophilic adhesion. It is expressed on activated leukocytes T cells, B cells, monocytes, hematopoietic stem cells (HSCs), metastasizing melanoma, neuronal cells, endothelial cells, hematopoiesis-supporting osteoblastic cell lines, and MDSCs. In one embodiment, the genetically engineered bacteria contain one or more gene(s) encoding a single chain antibody directed against CD166. In another embodiment, the genetically engineered OVs encode a single chain antibody directed against CD70. A non limiting example of a single chain antibody agains CD166 is described in Cancer Immunology, *Immunotherapy*, November 2010, Volume 59, Issue 11, pp 1665-1674.

In alternate embodiments, the anti-cancer molecule is selected from an anti-cancer molecule found in Table 34.

TABLE 34

Molecules that may be used as anti-cancer molecules through direct expression in bacteria

| Category | Anticancer molecule | Refs |
|---|---|---|
| Cytotoxic agents | Cly A | (34, 35) |
| | FASL | (36) |
| | TRAIL | (37) |
| | TNFα | (38, 39) |
| Cytokines | CCL21 | (41) |
| | IL-2 | (41, 42, 43) |
| | IL-18 | (43, 44) |
| | LIGHT | (44, 45) |
| Antigens and antibodies | CtxB-PSA fusion protein | (46) |
| | CPV-OmpA fusion protein | (47) |
| | NY-ESO-1 tumor antigen | (48) |
| | RAF1 | (49) |
| | Single chain HIF1α antibodies | (50) |
| DNA transfer | Endostatin | (53, 57) |
| | Thrombospondin-1 | (54) |
| | TRAIL and SMAC | (53) |
| | Stat3 | (54, 55, 57) |
| | Bcl2 | (56, 57, 58) |
| | FLT3L | (58) |
| | GM-CSF | (57) |
| | IL-12 | (58, 61) |
| | AFP | (62) |
| | VEGFR2 | (63) |
| Enzymes | *E. coli* CD | (64, 65) |
| | HSV-TK | (66) |

Cly A (also known as HlyeE), Cytolysin A; FASL, FAS ligand; TRAIL, TNF-related apoptosis-inducing ligand; TNFα, tumor necrosis factor-α; CCL, collagen cross-linking; IL, interleukin; PSA, prostate-specific antigen; CtxB, cholera toxin subunit B; CPV, canine parvovirus; HIF1α, hypoxia-inducible factor 1-alpha; FLT3L, FMS-like tyrosine kinase 3 ligand; GM-CSF, granulocyte/macrophage colony stimulating factor; AFP, α-fetoprotein; VEGFR, vascular endothelial growth factor receptor; CD, cytosine deaminase; KSV-TK, herpes simplex virus thymidine kinase.

Other anti-cancer molecules include therapeutic nucleic acids (RNA and DNA), for example, RNAi molecules (such as siRNA, miRNA, dsRNA), mRNAs, antisense molecules, aptamers, and CRISPER/Cas 9 molecules. Thus, in some embodiments, the genetically engineered bacteria or genetically engineered oncolytic virus comprise sequence(s) for producing one or anti-cancer molecules that are RNA or DNA anti-cancer molecules, eg., including nucleic acid molecules selected from RNAi molecules (siRNA, miRNA, dsRNA), mRNAs, antisense molecules, aptamers, and CRISPER/Cas 9 molecules. Such molecules are exemplified and discussed in the references provided herein below.

Antisense molecule may be introduced into a cell to inhibit translation of a complementary mRNA by base pairing to it and physically obstructing the translation machinery; antisense RNA occurs in nature and artificial antisense molecules can be generated to modulate gene expression (Masayori Inouye, Gene, Volume 72, Issues 1-2, 10 Dec. 1988, Pages 25-34 Antisense RNA: its functions and applications in gene regulation—a review). Antisense nucleic acid are oligomeric nucleic acids that are at least partially complementary to a target nucleic acid molecule to which it hybridizes. The antisense nucleic acid modulates (increases or decreases) expression or amount of a target nucleic acid.

Synthetic small interfering RNAs (siRNAs) are an indispensable tool to investigate gene function in eukaryotic cells and may be used for therapeutic purposes to knockdown genes implicated in disease. Effectors of RNAi are small interfering RNAs (siRNA) and microRNAs (miRNA). RNAi molecules include both extrinsic short interfering RNAs (siRNAs) and intrinsic antisense RNAs (AS-RNA), and microRNAs (miRNAs), and modulate post-transcriptional and sequence-specific gene silencing. First, siRNAs and miRNAs are processed by the ribonuclease DICER to produce short double-stranded RNAs (dsRNAs) of 20-24 base pairs that in the cytoplasm are recognized by the RNA-induced silencing complex (RISC). The RISC drives the strand that directs silencing (guide strand) to the target mRNA, while the other strand (passenger strand) is degraded. Depending on the degree of complementarity, the hybridization of guide strand to the mRNA prevents translation or induces degradation. SiRNAs that show a perfect complementarity to their target mRNA, induce gene silencing through a sequence-specific cleavage of the target RNA, whereas microRNAs, that show a partial complementarity, can mediate translational repression or transcript degradation. In the laboratory setting, siRNA is synthesized externally and then introduced to the cell.

shRNA is short hairpin RNA, double stranded RNA (dsRNA) which is delivered to the cell via a DNA construct encoding a sequence of single stranded RNA and its complement, separated by a stuffer fragment, allowing the RNA molecule to fold back on itself, creating a dsRNA molecule with a hairpin loop. The vector either integrates into the host genome or persists in the nucleus. Additionally, shRNA can also be synthesized exogenously and delivered similar to RNA. When produced inside the cell from a DNA construct, it has the positive characteristics of siRNA, yet is produced continuously by the target cell's own machinery.

In certain embodiments, bacteria can be used to deliver siRNA or shRNA to target cells.

Two methods have been contemplated to deliver therapeutic RNAi effectors into cancer cells. Therapeutic shRNAs can be delivered into target cells by invasive bacteria, which themselves produce the shRNA, and then is delivered to the target cells ("transkingdom RNAi", tkRNAi; (Ahmed et al., Delivery of siRNAs to Cancer Cells via bacteria, 2015). Alternatively, invasive bacteria can carry and transfer the shRNA containing constructs to the host cell, where they act as a template for transcription the shRNA by host cells transcription machinery (bacteria mediated RNAi, bm-RNAi; Nguyen et al., Bacterial vectors for RNAi delivery. In; Slator R., Hill C., eds. Patho-biotechnology).

Bacteria-mediated RNA interference (bmRNAi) delivery through the use of invasive bacteria such as *Salmonella typhimurium* is another approach that employs naturally invasive bacteria to deliver RNA interference (Bacterial Vectors for RNAi Delivery Thu Nguyen and Johannes H. Fruehauf). In bacteria-mediated shRNA expression, plasmids are transferred to the host cell, which then utilizes its own transcriptional machinery to produce shRNA in the nucleus. Attenuated *S. typhimurium*, such as attenuated *S. typhimurium* is SL720717 in which the aroA gene is inactivated to make the bacteria dependent on aromatic amino acids, has successfully been used in the past as a means of delivery for a wide variety of therapeutic payloads from proteins to DNA for vaccine or gene therapy applications. Host cell invasion, results in rapid lysis and liberation of their payload.

For "trans kingdom RNAi" (tksiRNA) a specialized vector is necessary (e.g., TRIP vectors), which allows expression of the gene of interest driven by strong promoter and a strong terminator, e.g., *E. coli* Plac UV5 or T7 promoter, allowing accumulation of the therapeutic RNAi molecules inside the cell. For invasion of the target cell, the inv locus expressing Invasin from *Yersinia* pseudotuberculoris in combination with pore-forming toxin LLO encoded by the HLyA gene from *Listeria monocytogenes* has been be used. The Invasin is expressed on the cell surface and interacts with beta 1 integrin on mammalian cells, resulting in the endosomal uptake of the bacteria by the mammalian target cell. After the bacteria enter the host cell, the bacterial wall is destroyed and the therapeutic shRNA molecules are released. Finally, the endosomal vehicle has is lysed by LLO allowing the therapeutic shRNAs to enter the cytoplasm (Ahmed et al., Delivery of siRNAs to Cancer Cells via bacteria, 2015). As an example, using this method, constructs containing Inv and HlyA were introduced into non-pathogenic *E. coli*, BL21DE3, which contains the T7 RNA polymerase to drive expression of beta catenin shRNA from a T7 promoter. Oral or intravenous administration of *E. coli* encoding beta-catenin shRNA, resulted in gene silencing in a human colon cancer xenograft model (Xiang et al., Nature Biotechnology 24, 697-702 (2006) Short hairpin RNA—expressing bacteria elicit RNA interference in mammals) indicating that the shRNA was functionally active.

Recently, it has been discovered that *E. coli* RNase III (an ancestor of eukaryotic Dicer) can generate siRNA-sized dsRNAs from longer dsRNAs, which are functionally active in mammalian cells. This method requires the presence of an exogenously provided viral siRNA-binding protein p19 (encoded by the plant RNA virus tombusvirus), known to stabilize the approximately 21 nt siRNAs (Huang et al., Nat Biotechnol. 2013 April; 31(4): 350-356. Using this method, a pool of siRNAs can be generated (termed "pro-siRNA") in *E. coli*-transfected with the gene for a viral siRNA-binding protein and a long-hairpin dsRNA. Using this pool, target gene expression was knocked down by about 90% in HeLa- and HCT116-derived human cell lines upon transfection of the bacterially generated siRNAs. Since these siRNAs are made from transcribed longer dsRNAs, consequently the resulting siRNAs contain many sequences against one target. A pool of several siRNAs can sometimes be more effective and have fewer off-target effects than any one single siRNA (Morlighem J E, Petit C, Tzertzinis G. Determination of silencing potency of synthetic and RNase III-generated siRNA using a secreted luciferase assay. Biotechniques. 2007; 42:599-605).

It is understood that this method may be advantageous for the delivery of bacterially produced siRNA directed against a gene of interest directly to the tumor. In some embodiments, shRNA or siRNA produced by the genetically engineered bacteria or OVs may be used to inhibit an immune suppressive molecule described herein. In other embodiments, the bacteria may deliver shRNA directed against a promoter of tumorigenesis.

In other embodiments, a microRNA or micro RNA mimic may be delivered. "microRNA mimic" refers to synthetic non-coding RNAs that are capable of entering the RNAi pathway and regulating gene expression. As used herein, "synthetic microRNA" refers to any type of RNA sequence, other than endogenous microRNA. microRNA mimics imitate the function of endogeneous microRNAs and can be designed as mature, double-stranded molecules or mimic precursors (e.g., pri- or pre-microRNAs). In other embodiments, antiMir may be delivered. Anti-miRs are miRNA Inhibitors are single stranded nucleic acids designed to specifically bind to and inhibit endogenous microRNA (miRNA) molecules.

Aptamers are single-stranded nucleic acid molecules with secondary structures that facilitate high-affinity binding to a target molecule. Aptamers can be comprised of ssDNA, RNA or derivatives thereof and provide high affinity ligands and potential antagonists of disease-associated proteins. Aptamers are short, structured, single-stranded RNA or DNA ligands that bind to target molecules with high specificity and affinity (Kd in the low nanomolar-picomolar range). In the last decade, aptamers that target the extracellular domain of transmembrane receptors overexpressed in tumors have been generated, thus becoming, along with monoclonal antibodies, ideal tools for the specific recognition of cancer cell surface.

In addition, aptamers can be taken up into cells and modulate the activity of intracellular targets. Aptamers will recognize and inhibit their intra-cellular cognate ligands once inside the cell, and thereby modulate gene function at the protein level. Aptamers that bind to soluble proteins have also been described. A number of immune modulators have been targeted by aptamers (reviewed in NS Que-Gewirth and BA Sullenger, Gene Therapy (2007) 14, 283-291 Gene therapy progress and prospects: RNA aptamers).

Aptamers have been used for cell type-specific delivery of siRNAs by joining the siRNAs to RNA molecules called aptamers (McNamara, J. O. II et al. (2006). Cell type-specific delivery of siRNAs with aptamer-siRNA chimeras. Nat. Biotechnol. 24: 1005-15. And Chu, T. C. et al. (2006). Aptamer mediated siRNA delivery. Nucleic Acids Res. 34: e73; see also Partnering Aptamer and RNAi Technologies MOLECULAR THERAPY Vol. 14, No. 4, October 2006). IN certain embodiments aptamers joined to siRNAs may be produced and delivered by the genetically engineered bacteria of the invention. In these studies, the aptamer is extended at the 3'end with a tail complementary to the antisense strand of the siRNA (nonfunctional or sense strand) and then annealed with the siRNA antisense strand (functional strand), generating a completely RNA-based molecule. In addition, a truncated version of A10 aptamer (A10-3) was linked to a short hairpin RNAs (shRNAs) against the DNA-activated protein kinase by generating a single molecules.

Aptamer expression cassettes that provide high intracellular levels of transcribed aptamers have been designed with various promoters, including RNA Pol II (CMV, Hic, Mtn), which directs the cytoplasmic export of the nascent transcript from the nucleus and RNA Pol I and Pol III (tRNAU6, H1). The promoter choice is essential to achieve robust shRNA, siRNA, or aptamer expression. At first, polymerase III promoters such as U6 and H1 were usedhowever, there has been a shift to using polymerase II promoters to regulate shRNA expression. IN some embodiments the engineered bacteria comprise a gene of interest driven by a Pol III promoter (e.g., as described in U.S. Pat. No. 6,146,886). In some embodiments the engineered bacteria comprise a gene of interest driven by a Pol II promoter.

Additional RNAi for Microbes:
Nguyen T, Fruehauf J H. Bacterial Vectors for RNAi Delivery. In: Madame Curie Bioscience Database [Internet]. Austin (Tex.): Landes Bioscience; 2000-2013. Available from: http://www.ncbi.nlm.nih.gov/books/NBK6085/
Nat Biotechnol. 2013 April; 31(4):350-6. doi: 10.1038/nbt.2537. Epub 2013 Mar. 10.
Shuanglin Xiang Nature Biotechnology 24, 697-702 (2006) Published online: 14 May 2006|doi:10.1038/nbt1211 RNA polymerase III-based expression of therapeutic RNAs, U.S. Pat. No. 6,146,886 A
CRISR Gene Editing:
CRISPR-Cas Systems in Bacteria and Archaea: Versatile Small RNAs for Adaptive Defense and Regulation Annual Review of Genetics Vol. 45: 273-297 (Volume publication date December 2011) DOI: 10.1146/annurev-genet-110410-132430
David Benjamin Turitz Cox, Randall Jeffrey Platt, & Feng Zhang, NATURE MEDICINE VOLUME 21| NUMBER 2| FEBRUARY 2015

Antisense:
Masayori Inouye, Gene, Volume 72, Issues 1-2, 10 Dec. 1988, Pages 25-34 RNA polymerase III-based expression of therapeutic RNAs, U.S. Pat. No. 6,146,886 A Aptamers:
RNA polymerase III-based expression of therapeutic RNAs, U.S. Pat. No. 6,146,886 A
Gene Therapy (2007) 14, 283-291. doi:10.1038/sj.gt.3302900; Gene therapy progress and prospects: RNA aptamers; N S Que-Gewirthl and B A Sullengerl
Adoptive Cell Transfer "Adoptive cell transfer" or "ACT" refers to the transfer of cells into a patient as a form of cancer immunotherapy. The cells may have originated from the patient (autologous) and then been altered before being transferred back, or, they may have come from another individual (heterologous). Transferring autologous cells, or cells from the patient, minimizes graft-versus-host disease (GVHD). "Adoptive cell therapy" refers to any therapy comprising cells suitable for adoptive cell transfer. The cells are most commonly derived from the immune system, with the goal of transferring improved immune functionality and characteristics along with the cells back to the patient. Examples of immune cell types for transfer include tumor infiltrating lymphocyte (TIL), TCR (i.e. heterologous T-cell receptor) modified lymphocytes and CAR (i.e. chimeric antigen receptor) modified lymphocytes. Other adoptive cell therapies comprise transfer of cell types selected from T-cells, CD8+ cells, CD4+ cells, NK-cells, delta-gamma T-cells, and peripheral blood mononuclear cells.

Adoptive T cell therapy involves the isolation and ex vivo expansion of tumor specific T cells to achieve greater number of T cells than what could be obtained by vaccination alone. The tumor specific T cells are then infused into patients with cancer in an attempt to give their immune system the ability to overwhelm remaining tumor via T cells which can attack and kill cancer. There are many forms of adoptive T cell therapy being used for cancer treatment, including culturing tumor infiltrating lymphocytes (TIL), isolating and expanding one particular T cell or clone, and using T cells that have been engineered to potently recognize and attack tumors.

The use of "tumor-infiltrating lymphocytes" or TILs, refers to the transfer of white blood cells that have left the bloodstream and migrated into a tumor. Lymphocytes can be divided into three groups including B cells, T cells and natural killer cells. Some adoptive cell therapy comprises T-cells, which have been modified with target-specific chimeric antigen receptors or specifically selected T-cell receptors. Useful T cells are CD3+ cells, including CD4+ helper cells, CD8+ cytotoxic T-cells and gamma/delta T cells. The biological rationale for TILs is to augment the number of tumor associated antigen-specific T cells in the patient. This involves ex vivo expansion of autologous T cells and their adoptive transfer back into the patient under lymophodepleting conditions, without any further modifications to the T cells.

In other adoptive cell therapies, tumor antigen specific cytotoxic T cells (CTL) can be infused which can directly kill tumor cells. More recently, however, adoptive transfer of T-cells genetically modified to recognize malignancy-associated antigens have been employed as new approach to treating cancer. Antitumor receptors genetically engineered into normal T cells can be used. Recent advances in T cell engineering and gene transfer have led to the development of two distinct types of gene-modified T cells, both of which express novel engineered receptors capable of recognizing TAAs with high affinity. For example, T cells can be redirected by the integration of genes encoding either conventional alpha-beta TCRs or CARs.

With respect to TAA, T cells can be taken directly from the patient's blood after they have received a cancer vaccine so that the Tcells are primed. "Priming" rare tumor antigen specific T cells first, with active immunization, result in the greater expansion of tumor specific antigens. Using tumor specific CD4+ Th1 cells further enhances anti-tumor efficacy because they can activate antigen-specific effector cells and recruit cells of the innate immune system such as macrophages and dendritic cells to assist in antigen presentation (APC). Moreover, antigen primed Th cells can directly activate tumor antigen-specific CTL. In addition to direct contact, Th can activate CTL through cytokines such as IL-2 which stimulate the growth and expansion of effector T cells. In addition, Th1 induce the production of opsonizing antibodies that enhance the uptake of tumor cells into APC. These activated APC can then directly present tumor antigens to T cells. As a result of activating APC, antigen specific Th1 can initiate epitope or determinant spreading, which broadens immunity to other antigens in the tumor. The ability to elicit epitope spreading broadens the immune response to many potential antigens in the tumor results in more efficient tumor cell kill due to the ability to mount a heterogeneic response. In this way, adoptive T cell therapy can be used to stimulate endogenous immunity. CD4+ T cells can also promote tumor rejection. CD4+ T cells enhance CD8+ T cell function and can directly destroy tumor cells. Evidence suggests that T helper 17 cells can promote sustained antitumor immunity.

Another T cell adoptive therapy employs the use of chimeric antigen receptors, or CARs, to redirect the specificity of cytotoxic and helper T cells. A chimeric antigen receptor (CAR) is an artificially constructed hybrid protein or polypeptide containing an antigen binding domain of an antibody (e.g., a scFv) linked to T-cell signaling or T-cell activation domains. For example, CARs can be constructed by linking the variable regions of the antibody heavy and light chains to intracellular signaling chains such as CD3-zeta, potentially including costimulatory domains encoding CD28 or CD137. CARs can provide recognition of cell surface components not restricted to major histocompatibility complexes (MHC). CARs have the ability to redirect T-cell specificity and reactivity toward a selected target in a non-MHC-restricted manner, exploiting the antigen-binding properties of monoclonal antibodies. The non-MHC-restricted antigen recognition gives T-cells expressing CARs the ability to recognize an antigen independent of antigen processing, thus bypassing mechanisms of tumor escape (e.g., thymic selection, MHC-downregulation and altered peptide processing). Three generations of CARS have been developed and are for example described in Kershaw et al. Nature Reviews Cancer 13, 525-541 (2013), Gene-engineered T cells for cancer therapy). can be constructed by linking the variable regions of the antibody heavy and light chains to intracellular signaling chains such as CD3-zeta, potentially including costimulatory domains encoding CD28 or CD137. CARs can provide recognition of cell surface components not restricted to major histocompatibility complexes (MHC). They can be introduced into T cells with high efficiency using viral vectors.

In addition, native TCRs can be recombinantly engineered ex vivo; the resulting engineered genes are reintroduced into autologous T cells and transferred back into patients. Yeast or T cell display systems can be used to generate high affinity TCRs (membrane bound or soluble), according to methods known in the art and for example described in Stone et al., Methods Enzymol. 2012; 503:189-222; T cell receptor engineering).

The adoptive transfer of autologous tumor infiltrating lymphocytes (TIL) or genetically re-directed peripheral blood mononuclear cells has been used to treat patients with advanced solid tumors, including melanoma and colorectal carcinoma, as well as patients with CD19-expressing hematologic malignancies. Recently, the technique has been expanded to treat cervical cancer, lymphoma, leukemia, bile duct cancernandeuroblastoma lung cancer, breast cancer, sarcoma and melanoma. Also in 16 CD19-specific chimeric antigen receptor (CAR)-modified T cells were used to treat patients with relapsed and refractory CD19+B cell malignancies, including B cell acute lymphoblastic leukemia (B-ALL) harboring rearrangement of the mixed lineage leukemia (MLL) gene with CD19 CAR-T cells.

Thus, ACT has the potential to enhance antitumor and overall immunity, and augment vaccine efficacy. The ability to genetically engineer lymphocyte subsets has the further potential to improve the natural immune response, correct impaired immunity, and redirect T cells to an antitumor effector response.

In some embodiments the genetically engineered bacteria or OVs may be administered in combination with a therapeutic adoptive cell therapy, such as any of the adoptive cell therapy described herein and known in the art.

Antibody Immune Engagement

Recently, distinct approaches have been developed which directly engages any T cell (regardless of their specificity) and a specific antigen expressing tumor cell, i.e., the T cell can be engaged through an antigen, which is different from the one recognized by their native TCell receptors (TCRs). The T cell is then redirected to kill the tumor cell expressing the specific antigen. As a result, larger numbers of T cells can be activated, since the activation is independent of their specificities. Such modalities employ bi-specific agents, which can "build a bridge" between the T cell (e.g., through binding CD3) and the tumor cell (by recognizing a tumor specific antigen). These modalities include, but are not limited to, soluble TCRs with effector functions and bi-specific T cell engagers.

Soluble TCRs

T-cell receptor is a membrane-bound heterodimeric protein expressed on the surface of CD4+ T cells and CD8+ T cells, through which these cells recognize a specific antigen presented in the context of an MHC molecule on target cells. The TCR has a T-cell receptor a-chain and T-cell receptor β-chain, wherein each chain contains a variable region and a constant region, transmembrane domain, and cytosolic domain. The variable and constant regions are generally homologous to immunoglobulin variable and constant regions and comprise three complementarity-determining regions (CDRs). Both TcR chains are anchored in the membrane of the cell presenting the TcR. Unlike antibodies, TCRs are not secreted.

Recently, methods have been developed that allow engineering of TCRs as soluble proteins with high affinities. These TCRs can also be fused to various immune-modulator molecules; these fusion proteins allow the recognition of a new realm of targets in cancer therapy.

Soluble T-cell receptors (sTCRs) are heterodimeric truncated variants of native TcRs which contain the extracellular portions of the TcR a-chain and β-chains, e.g., linked by a disulfide bond, but lack the transmembrane and cytosolic domains of the native protein. Soluble TCRs also may be engineered to have enhanced antigen recognition ("affinity-enhanced" TCRs, see e.g., Li et al. Directed evolution of human T-cell receptors with picomolar affinities by phage display. Nat Biotechnol. 2005; 23:349-54).

In addition, soluble TCRs have been recombinantly combined with effector functions. These reagents then combine high-affinity tumor associated antigen recognition with T cell activation, usually via an anti-CD3 scFv antibody fragment. As a result, the T cell is activated independently of its natural specificity. As an example, ImmTacs (Immune mobilising monoclonal TCRs Against Cancer) combine an affinity-enhanced soluble TCR with an anti-CD3 scFv effector function, which binds to T cells and activate a highly potent and specific T cell response to recognize and destroy cancer cells (see, e.g., Liddy N, Bossi G, Adams K J, Lissina A, Mahon T M, Hassan N J, et al. Monoclonal TCR-redirected tumor cell killing. Nat Med. 2012; 18:980-7). Redirected T cells generate multiple effector functions including the production of various cytokines. ImmTAC-activated CD8+ T cells include various subsets of memory cells (Oates and Jacobsen, Oncoimmunology. 2013 Feb. 1; 2(2): e2289; ImmTACs Novel bi-specific agents for targeted cancer therapy).

In some embodiments, the genetically engineered bacteria or genetically engineered OVS are engineered to produce one or more TCRs. In some embodiments, the genetically engineered bacteria or genetically engineered OVS have sequence to encode one or more TCRs. In other embodiments, one or more TCRs can be administered in combination with a genetically engineered bacteria or genetically engineered oncolytic virus of the present invention.

Bi-Specific T Cell Engagers (BiTE)

BiTE antibodies are recombinant fusion proteins consisting of scFvs of two different antibodies, which are connected by a flexible linker, and therefore have two different binding sites. Several applications of BiTEs relate to bringing immune cells into proximity of the cancer cell. By employing variable domains with binding specificities against different surface antigens of malignant cells and linking them to a CD3-binding domain, BiTEs can potentially be engineered to target a wide range of tumors. For example, in the case of Blinatumomab, one of the scFvs binds to T cells via the CD3 receptor, and the other to CD19 expressed on a tumor cell, allowing the redirection of cytotoxic T cells to destroy tumor cells. Mechanistically, BiTE may therefore induce cytolytic immunological synapses between cytotoxic T cells and target cells that are similar to normal T-cell synapses. Ongoing or completed phase I/II studies with blintomumab suggest that T cells engage and lyse tumors (see. e.g., Lum and Thakur, BioDrugs. 2011 Dec. 1; 25(6): 365-379. Targeting T Cells with Bispecific Antibodies for Cancer Therapy). Due to their small size and lack of Fc region, BiTEs have a short serum half-life. However, they are potent and can induce specific antitumoral cytotoxicity (target lysis of cultured cells). Thereby, BiTEs are not 'consumed' but, as recruiter molecules, enable repeated rounds of target cell lysis by T cells at low effector:target cell ratios (Kontermann and Brinkmann; Drug Discovery Today 2015 20 (7), 838-847; Bipecific Antibodies). Select non-limiting examples of BiTE scFvs are included in Table 35 below.

TABLE 35

Selected BiTE single chain variable fragment fusion proteins in clinical development

| Molecule | Targets | Mechanism of Action | Indication |
| --- | --- | --- | --- |
| Blinatumomab AMG103 MT103 | CD19 + CD3 | T cell recruitment | B cell ALL; ALL relapsed refractory; ALL pediatric |
| MT111, MEDI565 | CEA + CD3 | T cell recruitment | Gastric cancer advanced adenocarcinoma |
| MT112 BAY2010112 | PSMA + CD3 | T cell recruitment | Prostate cancer |
| MT110 AMG 110 | EPCAM + CD3 | T cell recruitment | Lung and gastro-intestinal cancer |

Blinatumomab

```
SEQ ID NO: 562:
single chain variable fragment fusion protein
DIQLTQSPASLAVSLGQRATISCKASQSVDYDGDSYLNWYQQIPGQPPK

LLIYDASNLVSGIPPRFSGSGSGTDFTLNIHPVEKVDAATYHCQQSTED

PWTFGGGTKLEIKGGGGSGGGGSGGGGSQVQLQQSGAELVRPGSSVKIS

CKASGYAFSSYWMNWVKQRPGQGLEWIGQIWPGDGDTNYNGKFKGKATL

TADESSSTAYMQLSSLASEDSAVYFCARRETTTVGRYYYAMDYWGQGTT

VTVSSGGGGSDIKLQQSGAELARPGASVKMSCKTSGYTFTRYTMHWVKQ

RPGQGLEWIGYINPSRGYTNYNQKFKDKATLTTDKSSSTAYMQLSSLTS

EDSAVYYCARYYDDHYCLDYWGQGTTLTVSSVEGGSGGSGGSGGSGGVD

DIQLTQSPAIMSASPGEKVTMTCRASSSVSYMNWYQQKSGTSPKRWIYD

TSKVASGVPYRFSGSGSGTSYSLTISSMEAEDAATYYCQQWSSNPLTFG

AGTKLELKHHHHHH
```

In some embodiments, the genetically engineered bacteria or genetically engineered OVS may encode one or more BiTE antibody(ies), e.g., directed against one or more of the immune modulators described herein. For example, in some embodiments, the BiTE antibody is directed against an immune checkpoint, e.g., against CTLA-4, PD-1, or PD-L1. In some embodiments, the BiTE antibody is directed against an immune-suppressive cytokine or chemokine, e.g., CSF1R, CCL2, IL-10, and TGF-β. In some embodiments, the BiTE antibody is directed against a molecule that promotes angiogenesis, e.g., VEGF, CXCR4/CXCL12, HIF-1α, galectin, neuropilin, and Tie-2. In some embodiments, the BiTE antibody is directed against CD47 or Sirpa. In other embodiments, one or more BiTE antibodies can be administered in combination with a genetically engineered bacteria or genetically engineered oncolytic virus of the present invention.

Antibody Dependent Cell-Mediated Cytotoxicity

"Antibody-dependent cell-mediated cytotoxicity" and "ADCC" refer to a cell-mediated reaction, in which non-specific cytotoxic cells that express Fc receptors (FcRs), such as NK cells, neutrophils, and macrophages recognize bound antibody on a target cell and subsequently cause lysis of the target cell. NK cells are thought to be the primary mediators of ADCC.

NK cells (5-15% of all circulating lymphocytes) are divided into two major subpopulations with distinct effector function, CD56dim CD16+ and CD56bright CD16−; the CD56dim CD16+ subset makes up 90% of all peripheral NK cells and mediates an early response via direct cellular cytotoxicity induced by perforin and granzyme, FasL, and TRAIL interactions as well as cytokine production, as summarized in Seidel et al., Front Immunol. 2013; 4: 76; Natural Killer Cell Mediated Antibody-Dependent Cellular Cytotoxicity in Tumor Immunotherapy with Therapeutic Antibodies), the contents of which is herein incorporated by reference in its entirety. NK cell activation and cytotoxicity is controlled by a complex balance between activating receptors, inhibitory receptors and co-receptors (described in Seidel et al. and references therein).

NK cells constitutively express perforin, allowing fast delivery of apoptosis-inducing granzymes upon recognition of the tumor cell by the NK cell. The CD56bright CD16− subset then confers a more delayed, sustained effector function by secretion of cytokine and chemokines, including interferon gamma. Three types of FcγRs recognize the Fc part of IgG antibody subclasses with different affinities; NK cells, express FcγRIII only, whereas monocytes express FcγRI, FcγRII and FcγRIII. Activating low affinity FcγRIIIa (type III receptor for IgG; CD16) mediates ADCC and is highly expressed on the cytotoxic CD56dim CD16+NK cell subset as well as on other hematopoietic cells. NK cells are thought to be the key mediators of ADCC, since only NK cells do not co-express the inhibitory FcγRIIb. Antibodies of the subclasses IgG1 and IgG3 bind to FcγRIIIa inducing a potent activating signal, which overcomes inhibitory signals and results in both cytotoxicity and a cytokine response.

Antibodies have become a major therapeutic tool for the treatment of all classes of malignancy. Antibodies can directly target tumor cells for killing, or can target immunoregulatory pathways to boost antitumor immune responses by activating the immune system. One characteristic of antibodies is their bifunctional nature. The variable Fab region of an antibody mediates specificity and dictates to what antigen and with what affinity the antibody will bind its target. Antibodies also contain a constant region, termed the Fc domain, which engages a diversity of cellular receptors, thereby triggering antibody-mediated effector functions. The IgG Fc domain connects the specificity of an antibody with immune cells that mediate antibody-triggered effector functions through their engagement of Fc receptor (FcR) family members. Thus, the Fc domain acts as a bridge between the specificity dictated by the Fab region and cells of the innate and adaptive immune system.

Therapeutic antibodies can target tumor antigens by Fab-mediated cross-linking of target molecules to trigger proapoptotic signaling cascades. In addition, the Fc domain plays an instrumental role in the effector mechanisms elicited by multiple classes of therapeutic antibodies, whether they directly target tumor cells or alternatively target the immune system, modulating either positive or negative regulatory pathways. Cytotoxic antitumor antibodies can stimulate long-term antitumor T-cell memory responses through an FcR-dependent "vaccinal effect". Thus, engineering Fc domains of therapeutic antibodies for optimal engagement of appropriate members of the FcR family can enhance antitumor activities capable of sustained responses. Antibodies can be optimized for enhanced engagement with the Fc gamma receptors (FcgRs) expressed on immune effector cells. Engineering antibodies with optimal affinities for certain of those FcgRs will lead to greater effector activation and greater killing of antibody-coated tumor cells. Antibody Fc gamma receptors (FcγRs) are present on a wide variety of effector cell populations, including NK cells, dendritic cells (DC), neutrophils, and macrophages.

Upon binding their cognate antigens, IgG antibodies mediate downstream effector functions by interacting with either type I or type II FcRs. Type I FcRs are members of the immunoglobulin (Ig) superfamily and include the canonical FcRs for IgG (FcγR). Type II FcRs are members of the C-type lectin receptor family and currently include CD209 (also known as DC-SIGN, which is homologous to SIGN-R1 in mice) and CD23. Whether type I or type II FcRs are engaged by an antibody is determined by the conformational state of its Fc domain, which is regulated by glycosylation at Asn297. Sialylated Fc domains adopt a more flexible, "closed" conformation that allows engagement of type II FcRs and reduces binding to type I FcRs. Nonsialylated Fc domains assume an "open" conformation, thereby allowing binding to type I FcRs and preventing engagement of type II FcRs. Engagement of type I FcRs results in antibody-dependent cellular cytotoxicity and phagocytosis (ADCC and ADCP), demonstrating the ability of an IgG to bridge target cells/pathogens and FcγR-expressing effector cells to mediate cytotoxicity or phagocytosis. Type I FcRs also engage antigen—antibody immune complexes (IC) and mediate their downstream immunomodulatory effects on antigen-presenting cells (APC) and B cells. Immunomodulatory effects mediated by ICs are observed on dendritic cells (DC), where ICs can enhance antigen uptake and regulate DC maturation in an FcγR-dependent fashion, thereby shaping T-cell responses.

Type I FcR family members comprise the canonical FcγRs, which can be classified into two functionally defined subclasses: activating and inhibitory FcγRs. The activating FcγRs, which include murine FcγRI, FcγRIII, and FcγRIV, as well as human FcγRI, FcγRIIA, and FcγRIIIA, initiate cellular activation through their intracellular immunoreceptor tyrosine—based activation motif (ITAM). Mouse natural killer (NK) cells exclusively express FcγRIII, and human NK cells primarily express FcγRIIIA; B cells of both species exclusively express the inhibitory FcγRIIB Human DCs only express a single activating FcγR, huFcγRIIA. Because most effector cells coexpress activation and inhibitory FcγRs, it is the relative ratio of the binding affinities of a specific IgG Fc to these receptors that will determine the outcome of the IgG-FcγR interaction. These binding affinities are determined by the amino acid sequences of the different IgG Fc subclasses and the N-linked glycan patterns of the IgG Fc domains. Thus, the IgG Fc composition can dramatically influence the in vivo outcome of an antibody—antigen complex engaging FcγRs on an innate cell, by directing the cell into either a proinflammatory or an anti-inflammatory state.

The Fc domains of antibodies can be engineered to enhance their affinity for certain Fc gamma receptors, for example, FcγRIIIa, leading to dramatic enhancements in ADCC. For example, the huIgG Fc region can be engineered to selectively enhance engagement of activating FcγRs, e.g., FcγRIIIa, by (i) modification of Fc-FcγR interactions through manipulating the Fc glycan at Asn297; and (ii) modification of Fc-FcγR interactions through the introduction of Fc domain point mutants. While NK cell-mediated lysis occurs predominantly through a single activating receptor FcγRIIIa, activation of antigen presenting cells such as DC and macrophages can also be influenced by the activating receptor FcγRIIa and inhibitory receptor FcγRIIb. In an effort to optimally tune antibodies for effector function, Fc variants with a variety of unique FcγR affinities and specificities, including selective engagement of FcγRIIIa and FcγRIIa over FcγRIIb have been generated. Results indicate that whereas NK cell-mediated killing is correlated strongly with FcγRIIIa affinity, phagocytosis by macrophages is dependent on binding to both FcγRIIa and FcγRIIIa. These variants have the potential to improve anti-cancer therapy by increasing not only innate effector functions, but also by enhancing adaptive anti-tumor responses, a novel feature of engineered therapeutic antibodies. Examples of Fc variants engineered to enhance their affinity for activating Fc gamma receptors, for example, FcγRIIIa, are known in the art. Dillio et al., Cancer Immunol Res; 3(7); 704-13).

ADCC is an important mechanism of action of a number of therapeutic monoclonal antibodies, including those listed in the table below. Additional antibodies in development are reviewed in Seidel et al., Front Immunol. 2013; 4: 76; Natural Killer Cell Mediated Antibody-Dependent Cellular Cytotoxicity in Tumor Immunotherapy with Therapeutic Antibodies), the contents of which is herein incorporated by reference in its entirety.

TABLE 36

ADCC-mediating therapeutic antibodies currently FDA approved for cancer therapy.

| Antibody | Antigen | Cancer indication | Mechanisms of action |
| --- | --- | --- | --- |
| Rituximab | CD20 | CD20+ B cell NHL, CD20+ follicular NHL, CLL | ADCC, CDC, direct induction of apoptosis |
| Ofatumumab | CD20 | CLL | ADCC, CDC |
| Trastuzumab | Her2/neu | Breast cancer | ADCC, abrogation of tumor cell signaling |
| Cetuximab | EGFR | colorectal cancer, SCCHN | ADCC, abrogation of tumor cell signaling |
| Alemtuzumab | CD52 | CLL | ADCC, CDC, direct induction of apoptosis |

In some embodiments, the genetically engineered bacteria or genetically engineered OVS may encode one or more antibody(ies) functioning in part or wholly through antibody dependent cell-mediated toxicity (ADCC). In some embodiments, said antibodies have modified Fc domains that enhance their affinity for FcγRIIIa receptors. In other embodiments, an antibody functioning in part or wholly through ADCC can be administered in combination with a genetically engineered bacteria or genetically engineered oncolytic virus of the present invention.

Combination Circuits—Combinations of Anti-Cancer Molecules

In embodiments, the genetically engineered bacteria are capable of producing two or more immune modulators that modulate T effector cells, e.g., CD4+ and CD8+ cells. In some embodiments, the genetically engineered bacteria are capable of producing two or more immune modulators that activate, stimulate, and/or induce the differentiation of T effector cells, e.g., CD4+ and CD8+ cells. In some embodiments, the immune modulators are cytokines that activate, stimulate, and/or induce the differentiation of T effector cells, e.g., CD4+ and CD8+ cells. In some embodiments, the genetically engineered bacteria are capable of producing two or more cytokines selected from IL-2, IL-15, IL-12, IL-7, IL-21, and IL-18. For example, in some embodiments, the genetically engineered bacteria comprise nucleic acid sequence(s) encoding two or more cytokines selected from IL-2, IL-15, IL-12, IL-7, IL-21, and IL-18. In some embodiments, the genetically engineered bacteria comprise nucleic acid sequence(s) encoding IL-2 and IL-15. In alternate embodiments, the disclosure provides a composition comprising a combination (e.g., two or more) of different genetically engineered bacteria, each bacteria encoding a different immune modulator. For example, in some embodiments, the composition comprises a genetically engineered bacteria comprising nucleic acid sequence(s) encoding IL-2 and a genetically engineered bacteria comprising nucleic acid sequence(s) encoding IL-15.

In some embodiments, the genetically engineered bacteria comprise nucleic acid sequence(s) encoding two or more agonists selected from CD40, CD28, ICOS, CD226, CD137 (4-1BB), and OX40 agonists, such as any of the CD40, CD28, ICOS, CD226, CD137 (4-1BB), and OX40 agonists disclosed herein. In some embodiments, the genetically engineered bacteria comprise nucleic acid sequence(s) encoding one or more cytokines selected from IL-2, IL-15, IL-12, IL-7, IL-21, and IL-18 and nucleic acid sequence(s) encoding one or more agonists selected from CD40, CD28, ICOS, CD226, CD137 (4-1BB), and OX40 agonists, such as any of the CD40, CD28, ICOS, CD226, CD137 (4-1BB), and OX40 agonists disclosed herein. In alternate embodiments, the disclosure provides a composition comprising a combination (e.g., two or more) of different genetically engineered bacteria, each bacteria encoding a different immune modulator. In some embodiments, the composition comprises a genetically engineered bacteria comprising nucleic acid sequence(s) encoding one or more cytokines selected from IL-2, IL-15, IL-12, IL-7, IL-21, and IL-18 and a genetically engineered bacteria comprising nucleic acid sequence(s) encoding one or more agonists selected from CD40, CD28, ICOS, CD226, CD137 (4-1BB), and OX40, agonists.

In some embodiments, the genetically engineered bacteria comprise nucleic acid sequence encoding GM-CSF and nucleic acid sequence encoding another immune modulator that promotes dendritic cell activation. In some embodiments, the genetically engineered bacteria comprise nucleic acid sequence(s) encoding one or more immune modulators that promote dendritic cell activation, e.g., GM-CSF and one or more agonists selected from CD40, CD28, ICOS, CD226, CD137 (4-1BB), and OX40 agonists, such as any of the CD40, CD28, ICOS, CD226, CD137 (4-1BB), and OX40 agonists disclosed herein. In some embodiments, the genetically engineered bacteria comprise nucleic acid sequence(s) encoding one or more immune modulators that promote dendritic cell activation, e.g., GM-CSF and nucleic acid sequence encoding one or more cytokines selected from IL-2, IL-15, IL-12, IL-7, IL-21, and IL-18. In some embodiments, the genetically engineered bacteria comprise nucleic acid sequence(s) encoding one or more immune modulators that promote dendritic cell activation, e.g., GM-CSF, nucleic acid sequence(s) encoding one or more cytokines selected from IL-2, IL-15, IL-12, IL-7, IL-21, and IL-18, and nucleic acid sequence(s) encoding one or more agonists selected from CD40, CD28, ICOS, CD226, CD137 (4-1BB), and OX40, agonists, such as any of the CD40, CD28, ICOS, CD226, CD137 (4-1BB), and OX40 agonists disclosed herein. In alternate embodiments, the disclosure provides a composition comprising a combination (e.g., two or more) of different genetically engineered bacteria, each bacteria encoding a different immune modulator. In some embodiments, the composition comprises a genetically engineered bacteria comprising nucleic acid sequence(s) encoding one or more cytokines selected from IL-2, IL-15, IL-12, IL-7, IL-21, and IL-18 and genetically engineered bacteria comprising nucleic acid sequence(s) encoding one or more agonists selected from CD40, CD28, ICOS, CD226, CD137 (4-1BB), and OX40, agonists and genetically engineered bacteria comprising nucleic acid sequence(s) encoding one or more immune modulators that promote dendritic cell activation, e.g., GM-CSF. In some embodiments, the composition comprises a genetically engineered bacteria comprising nucleic acid sequence(s) encoding one or more cytokines selected from IL-2, IL-15, IL-12, IL-7, IL-21, and IL-18 and genetically engineered bacteria comprising nucleic acid sequence(s) encoding one or more immune modulators that promote dendritic cell activation, e.g., GM-CSF. In some embodiments, the composition comprises a genetically engineered bacteria comprising nucleic acid sequence(s) encoding one or more agonists selected from CD40, CD28, ICOS, CD226, CD137 (4-1BB), and OX40, agonists and genetically engineered bacteria comprising nucleic acid sequence(s) encoding one or more immune modulators that promote dendritic cell activation, e.g., GM-CSF. In some embodiments, the genetically engineered bacteria are capable of producing two or more immune modulators that inhibit immune suppressor molecules, e.g., immune checkpoint molecules. In some embodiments, the genetically engineered bacteria are capable of producing two or more immune checkpoint inhibitors selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR checkpoint inhibitors, such as any of the immune checkpoint inhibitors disclosed herein. For example, in some embodiments, the genetically engineered bacteria comprise nucleic acid sequence(s) encoding two or more single-chain antibodies against any checkpoint molecules selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR molecules. In some embodiments, the genetically engineered bacteria comprise nucleic acid sequence(s) encoding single chain antibodies against CTLA-4 and PD-1. In alternate embodiments, the disclosure provides a composition comprising a combination (e.g., two or more) of different genetically engineered bacteria, each bacteria encoding a different immune modulator. In some embodiments, the composition comprises a genetically engineered bacteria comprising nucleic acid sequence(s) encoding one or more cytokines selected from IL-2, IL-15, IL-12, IL-7, IL-21, and IL-18 and genetically engineered bacteria are capable of producing one or more immune checkpoint inhibitors selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR checkpoint inhibitors. In some embodiments, the composition comprises genetically engineered bacteria comprising nucleic acid sequence(s) encoding one or more agonists selected from CD40, CD28, ICOS, CD226, CD137 (4-1BB), and OX40 agonists and genetically engineered bacteria are capable of producing one or more immune checkpoint inhibitors selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR checkpoint inhibitors. In some embodiments, the composition comprises genetically engineered bacteria comprising nucleic acid sequence(s) encoding one or more cytokines selected from IL-2, IL-15, IL-12, IL-7, IL-21, and IL-18 and genetically engineered bacteria comprising nucleic acid sequence(s) encoding one or more agonists selected from CD40, CD28, ICOS, CD226, CD137 (4-1BB), and OX40 agonists and genetically engineered bacteria capable of producing one or more immune checkpoint inhibitors selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR checkpoint inhibitors. In some embodiments, the genetically engineered bacteria are capable of producing two or more immune modulators that inhibit immune suppressors molecules, e.g., T regulatory cells, or Tregs. In some embodiments, the genetically engineered bacteria are capable of producing tryptophan and also metabolizing or degrading kynurenine. In some embodiments, the genetically engineered bacteria comprise a tryptophan operon, e.g., the tryptophan operon of *E. coli* or the tryptophan operon of *B. subtilis* and sequence encoding the enzyme kynureninase. In some embodiments, the genetically engineered bacteria comprise sequence(s) encoding trypE, trypG-D, trypC-F, trypB, and trpA genes and sequence encoding the enzyme kynureninase. In some embodiments, the genetically engineered bacteria comprise sequence(s) encoding trypE, trypD, trypC, trypF, trypB, and trpA genes and sequence encoding the enzyme kynureninase. In any of these embodiments, the tryptophan repressor (trpR) optionally may be deleted, mutated, or modified so as to diminish or obliterate its repressor function. Also, in any of these embodiments, the genetically engineered bacteria optionally comprise gene sequence(s) to produce the tryptophan precursor, Chorismate, e.g., sequence(s) encoding aroG, aroF, aroH, aroB, aroD, aroE, aroK, and AroC. In alternate embodiments, the disclosure provides a composition comprising a combination (e.g., two or more) of different genetically engineered bacteria, each bacteria encoding a different immune modulator. In some embodiments, the composition comprises a genetically engineered bacteria comprising nucleic acid sequence(s) encoding one or more cytokines selected from IL-2, IL-15, IL-12, IL-7, IL-21, and IL-18 and genetically engineered bacteria capable of producing tryptophan and/or metabolizing or degrading kynurenine. In some embodiments, the composition comprises genetically engineered bacteria capable of producing one or more immune checkpoint inhibitors selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR checkpoint inhibitors and genetically engineered bacteria capable of producing tryptophan and/or metabolizing or degrading kynurenine. In some embodiments, the composition comprises genetically engineered bacteria comprising nucleic acid sequence(s) encoding one or more agonists selected from CD40, CD28, ICOS, CD226, CD137 (4-1BB), and OX40 agonists and genetically engineered bacteria capable of producing tryptophan and/or metabolizing or degrading kynurenine. In some embodiments, the composition comprises genetically engineered bacteria capable of producing one or more immune checkpoint inhibitors selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR checkpoint inhibitors, genetically engineered bacteria comprising nucleic acid sequence(s) encoding one or more cytokines selected from IL-2, IL-15, IL-12, IL-7, IL-21, and IL-18 and genetically engineered bacteria capable of producing tryptophan and/or metabolizing or degrading kynurenine. In some embodiments, the composition comprises genetically engineered bacteria capable of producing one or more immune checkpoint inhibitors selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR checkpoint inhibitors, genetically engineered bacteria comprising nucleic acid sequence(s) encoding one or more cytokines selected from IL-2, IL-15, IL-12, IL-7, IL-21, and IL-18 and genetically engineered bacteria capable of producing tryptophan and/or metabolizing or degrading kynurenine and genetically engineered bacteria comprising nucleic acid sequence(s) encoding one or more agonists selected from CD40, CD28, ICOS, CD226, CD137 (4-1BB), and OX40 agonists.

In some embodiments, the genetically engineered bacteria are capable of producing two or more immune modulators that inhibit immune suppressors molecules, e.g., immune checkpoints and Tregs. In some embodiments, the genetically engineered bacteria are capable of producing tryptophan and also produce one or more immune checkpoint inhibitors selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR checkpoint inhibitors, such as any of the immune checkpoint inhibitors disclosed herein. In some embodiments, the genetically engineered bacteria comprise sequence(s) encoding trypE, trypG-D, trypC-F, trypB, and trpA genes or sequence(s) encoding trypE, trypD, trypC, trypF, trypB, and trpA genes and nucleic acid sequence(s) encoding one or more single-chain antibodies against any checkpoint molecules selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR molecules. In any of these embodiments, the tryptophan repressor (trpR) optionally may be deleted, mutated, or modified so as to diminish or obliterate its repressor function. Also, in any of these embodiments, the genetically engineered bacteria optionally comprise gene sequence(s) to produce the tryptophan precursor, Chorismate, e.g., sequence(s) encoding aroG, aroF, aroH, aroB, aroD, aroE, aroK, and AroC. In alternate embodiments, the disclosure provides a composition comprising a combination (e.g., two or more) of different genetically engineered bacteria, each bacteria encoding a different immune modulator. In some embodiments, the composition comprises genetically engineered bacteria capable of producing tryptophan and genetically engineered bacteria capable of producing one or more immune checkpoint inhibitors selected from PD-1, PD-L1, TIGIT, VISTA, LAG-3, TIM1, TIM3, CEACAM1, LAIR-1, HVEM, BTLA, CD160, CD200, CD200R, and A2aR checkpoint inhibitors.

In some embodiments, the genetically engineered bacteria are capable of metabolizing kynurenine and also producing one or more immune checkpoint inhibitors selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR checkpoint inhibitors, such as any of the immune checkpoint inhibitors disclosed herein. In some embodiments, the genetically engineered bacteria comprise nucleic acid sequence encoding kynureninase and nucleic acid sequence(s) encoding one or more single-chain antibodies against any checkpoint molecules selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR molecules. In alternate embodiments, the disclosure provides a composition comprising a combination (e.g., two or more) of different genetically engineered bacteria, each bacteria encoding a different immune modulator. In some embodiments, the composition comprises genetically engineered bacteria comprising nucleic acid sequence encoding kynureninase and genetically engineered bacteria comprising nucleic acid sequence(s) encoding one or more single-chain antibodies against any checkpoint molecules selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR molecules.

In some embodiments, the genetically engineered bacteria are capable of producing tryptophan, metabolizing kynurenine, and also produce one or more immune checkpoint inhibitors selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR checkpoint inhibitors, such as any of the immune checkpoint inhibitors disclosed herein. In some embodiments, the genetically engineered bacteria comprise sequence(s) encoding trypE, trypG-D, trypC-F, trypB, and trpA genes or sequence(s) encoding trypE, trypD, trypC, trypF, trypB, and trpA genes, nucleic acid sequence encoding kynureninase, and nucleic acid sequence(s) encoding one or more single-chain antibodies against any checkpoint molecules selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR molecules. In any of these embodiments, the tryptophan repressor (trpR) optionally may be deleted, mutated, or modified so as to diminish or obliterate its repressor function. Also, in any of these embodiments, the genetically engineered bacteria optionally comprise gene sequence(s) to produce the tryptophan precursor, Chorismate, e.g., sequence(s) encoding aroG, aroF, aroH, aroB, aroD, aroE, aroK, and AroC.

In any of the above combination embodiments, the bacterium further comprises gene sequence(s) for encoding a secretion system to secrete the one or more anti-cancer molecules from the bacterium. In any of the above combination embodiments, the secretion system is selected from the modified type III flagellar, type I (e.g., hemolysin secretion system), type II, type IV, type V, type VI, and type VII secretion systems, resistance-nodulation-division (RND) multi-drug efflux pumps, a single membrane secretion system, Sec and, TAT secretion systems. In any of the above combination embodiments, the genetically engineered bacterium further comprises gene sequence(s) encoding a secretion system for exporting tryptophan from the bacterium. In any of the above combination embodiments, the bacterium comprises one or more gene sequence(s) encoding YddG. In any of the above combination embodiments, the genetically engineered bacterium further comprises gene sequence(s) encoding a transporter for importing kynurenine into the bacterium. In any of the above combination embodiments, the bacterium comprises one or more copies of a gene sequence selected from aroP, tnaB, and mtr genes.

In any of the above combination embodiments, the engineered microorganisms are also capable of depleting adenosine from the tumor site. In any of the above combination embodiments, the bacterium comprises one or more gene(s) or a gene cassette comprising one or more genes for depleting adenosine from the intratumoral site. In any of the above combination embodiments, the bacterium comprises a gene cassette comprising one or more genes for converting adenosine to urate. In any of the above combination embodiments, the genetically engineered bacterium comprises gene sequence(s) encoding one or more copies of add, xapA, deoD, xdhA, xdhB, and xdhC genes. In any of the above combination embodiments, the bacterium comprises gene sequence(s) encoding a transporter for importing adenosine into the bacterium. In any of the above combination embodiments, the bacterium comprises gene sequence(s) for encoding a nucleoside transporter, e.g., an adenosine transporter. In any of the above combination embodiments, the genetically engineered bacterium comprises gene sequence(s) for encoding one or more copies of nupG or nupC from *E. coli*. In any of the above combination embodiments, the bacterium comprises one or more gene(s) or a gene cassette comprising one or more biosynthetic genes for synthesizing arginine. In any of the above combination embodiments, the bacterium comprises gene sequence(s) encoding one or more arginine biosynthesis genes selected from argA, argB, argC, argD, argE, argF, argG, argH, argI, argJ, carA, and carB. In any of the above combination embodiments for producing arginine, an arginine repressor (argR) is deleted, mutated, or modified so as to diminish or obliterate its repressor function. In any of the above combination embodiments for producing arginine, the bacterium comprises a gene encoding feedback resistant argA. In any of the above combination embodiments, the genetically engineered bacterium produce a cytotoxin or a lytic peptide. In any of the above combination embodiments, the gene sequence(s) for producing the one or more anti-cancer molecules and operatively linked promoter are present on a chromosome in the bacterium. In any of the above combination embodiments, the gene sequence(s) for producing the one or more anti-cancer molecules and operatively linked promoter are present on a plasmid in the bacterium. In any of the above combination embodiments the bacterium is an auxotroph comprising a deletion or mutation in a gene required for cell survival and/or growth, e.g., wherein the gene is selected from thyA, dapD, and dapA. In any of the above combination embodiment, the genetically engineered bacterium comprises a kill switch. In some embodiments, the disclosure provides a composition comprising engineered bacteria comprising gene(s) or a gene cassette comprising one or more genes for depleting adenosine and genetically engineered bacteria capable of producing tryptophan and/or metabolizing or degrading kynurenine, e.g., bacteria comprising nucleic acid sequence encoding kynureninase. In some embodiments, the composition further comprises engineered bacteria comprising nucleic acid sequence(s) encoding one or more single-chain antibodies against any checkpoint molecules selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR molecules. In some embodiments, the composition further comprises genetically engineered bacteria comprising nucleic acid sequence(s) encoding one or more agonists selected from CD40, CD28, ICOS, CD226, CD137 (4-1BB), and OX40 agonists. In some embodiments, the composition further comprises genetically engineered bacteria comprising nucleic acid sequence(s) encoding one or more cytokines selected from IL-2, IL-15, IL-12, IL-7, IL-21, and IL-18. In some embodiments, the composition further comprises genetically engineered bacteria capable of producing arginine.

In some embodiments, the genetically engineered bacteria are capable of producing one or more immune modulators that activate, stimulate, and/or induce the differentiation of T effector cells, e.g., CD4+ and CD8+ cells and also producing one or more immune modulators that inhibit immune suppressors molecules, e.g., immune checkpoints and Tregs. In some embodiments, the genetically engineered bacteria comprise nucleic acid sequence(s) encoding one or more immune modulators that activate, stimulate, and/or induce the differentiation of T effector cells, e.g., CD4+ and CD8+ cells and nucleic acid sequence encoding one or more single-chain antibodies against any checkpoint molecule, for example a checkpoint molecule selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR. In any of these embodiments, the nucleic acid sequence(s) encoding one or more immune modulators that activate, stimulate, and/or induce the differentiation of T effector cells may be sequence encoding one or more cytokines selected from IL-2, IL-15, IL-12, IL-7, IL-21, and IL-18, sequence encoding one or more agonists selected from CD40, CD28, ICOS, CD226, CD137 (4-1BB), and OX40, agonists, and/or sequence encoding an immune modulator that promotes dendritic cell activation, e.g., GM-CSF. For example, in some embodiments, the genetically engineered bacteria comprise nucleic acid sequence encoding IL-2 and/or IL-15 and nucleic acid sequence encoding a single-chain antibody against CTLA-4 and/or PD-1.

In some embodiments, the genetically engineered bacteria comprise nucleic acid sequence(s) encoding one or more immune modulators that activate, stimulate, and/or induce the differentiation of T effector cells, e.g., CD4+ and CD8+ cells and are also capable of producing tryptophan, e.g., comprise a tryptophan operon, for example the tryptophan operon of *E. coli* or the tryptophan operon of *B. subtilis*. In some embodiments, the genetically engineered bacteria comprise nucleic acid sequence(s) encoding one or more immune modulators that activate, stimulate, and/or induce the differentiation of T effector cells, e.g., CD4+ and CD8+ cells and nucleic acid sequence encoding trypE, trypG-D, trypC-F, trypB, and trpA genes. In some embodiments, the genetically engineered bacteria comprise nucleic acid sequence(s) encoding one or more immune modulators that activate, stimulate, and/or induce the differentiation of T effector cells, e.g., CD4+ and CD8+ cells and nucleic acid sequence encoding trypE, trypD, trypC, trypF, trypB, and trpA genes. In any of these embodiments, the tryptophan repressor (trpR) optionally may be deleted, mutated, or modified so as to diminish or obliterate its repressor function. Also, in any of these embodiments, the genetically engineered bacteria optionally comprise gene sequence(s) to produce the tryptophan precursor, Chorismate, e.g., sequence(s) encoding aroG, aroF, aroH, aroB, aroD, aroE, aroK, and AroC. In any of these embodiments, the nucleic acid sequence(s) encoding one or more immune modulators that activate, stimulate, and/or induce the differentiation of T effector cells may be sequence encoding one or more cytokines selected from IL-2, IL-15, IL-12, IL-7, IL-21, and IL-18, sequence encoding one or more agonists selected from CD40, CD28, ICOS, CD226, CD137 (4-1BB), and OX40, agonists, and/or sequence encoding an immune modulator that promotes dendritic cell activation, e.g., GM-CSF. For example, in some embodiments, the genetically engineered bacteria comprise nucleic acid sequence encoding IL-2 and/or IL-15 and nucleic acid sequence encoding trypE, trypG-D, trypC-F, trypB, and trpA genes or trypE, trypD, trypC, trypF, trypB, and trpA genes and optionally may comprise a deleted or mutated tryptophan repressor (trpR) and/or optionally comprise gene sequence(s) to produce the tryptophan precursor, Chorismate, e.g., sequence(s) encoding aroG, aroF, aroH, aroB, aroD, aroE, aroK, and AroC. In any of these embodiments, the genetically engineered bacteria may further comprise nucleic acid sequence encoding one or more single-chain antibodies against any checkpoint molecule, for example a checkpoint molecule selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR. Thus, in some embodiments, the genetically engineered bacteria comprise nucleic acid sequence encoding a cytokine, e.g., IL-2 and/or IL-15, nucleic acid sequence encoding trypE, trypG-D, trypC-F, trypB, and trpA genes or trypE, trypD, trypC, trypF, trypB, and trpA genes, and nucleic acid sequence encoding one or more single-chain antibodies against any checkpoint molecule, for example, CTLA-4 and/or PD-1.

In some embodiments, the genetically engineered bacteria comprise nucleic acid sequence(s) encoding one or more immune modulators that activate, stimulate, and/or induce the differentiation of T effector cells, e.g., CD4+ and CD8+ cells and are also capable of metabolizing or degrading kynurenine, e.g., comprise sequence encoding the enzyme kynureninase. In any of these embodiments, the nucleic acid sequence(s) encoding one or more immune modulators that activate, stimulate, and/or induce the differentiation of T effector cells may be sequence encoding one or more cytokines selected from IL-2, IL-15, IL-12, IL-7, IL-21, and IL-18, sequence encoding one or more agonists selected from CD40, CD28, ICOS, CD226, CD137 (4-1BB), and OX40, agonists, and/or sequence encoding an immune modulator that promotes dendritic cell activation, e.g., GM-CSF. For example, in some embodiments, the genetically engineered bacteria comprise nucleic acid sequence encoding IL-2 and/or IL-15 and nucleic acid sequence encoding kynureninase. In any of these embodiments, the genetically engineered bacteria may further comprise nucleic acid sequence encoding one or more single-chain antibodies against any checkpoint molecule, for example a checkpoint molecule selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR. Thus, in some embodiments, the genetically engineered bacteria comprise nucleic acid sequence encoding a cytokine, e.g., IL-2 and/or IL-15, nucleic acid sequence encoding kynureninase, and nucleic acid sequence encoding one or more single-chain antibodies against any checkpoint molecule, for example, CTLA-4 and/or PD-1.

In some embodiments, the genetically engineered bacteria comprise nucleic acid sequence(s) encoding one or more immune modulators that activate, stimulate, and/or induce the differentiation of T effector cells, e.g., CD4+ and CD8+ cells, are also capable of producing tryptophan, and can metabolize or degrade kynurenine. In some of these embodiments, the genetically engineered bacteria comprise a tryptophan operon, e.g., the tryptophan operon of E. coli or the tryptophan operon of B. subtilis and sequence encoding the enzyme kynureninase. In some embodiments, the genetically engineered bacteria comprise sequence(s) encoding trypE, trypG-D, trypC-F, trypB, and trpA genes and sequence encoding the enzyme kynureninase. In some embodiments, the genetically engineered bacteria comprise sequence(s) encoding trypE, trypD, trypC, trypF, trypB, and trpA genes and sequence encoding the enzyme kynureninase. In any of these embodiments, the tryptophan repressor (trpR) optionally may be deleted, mutated, or modified so as to diminish or obliterate its repressor function. Also, in any of these embodiments, the genetically engineered bacteria optionally comprise gene sequence(s) to produce the tryptophan precursor, Chorismate, e.g., sequence(s) encoding aroG, aroF, aroH, aroB, aroD, aroE, aroK, and AroC. In any of these embodiments, the nucleic acid sequence(s) encoding one or more immune modulators that activate, stimulate, and/or induce the differentiation of T effector cells may be sequence encoding one or more cytokines selected from IL-2, IL-15, IL-12, IL-7, IL-21, and IL-18, sequence encoding one or more agonists selected from CD40, CD28, ICOS, CD226, CD137 (4-1BB), and OX40, agonists, and/or sequence encoding an immune modulator that promotes dendritic cell activation, e.g., GM-CSF. For example, in some embodiments, the genetically engineered bacteria comprise nucleic acid sequence encoding IL-2 and/or IL-15, nucleic acid sequence encoding trypE, trypG-D, trypC-F, trypB, and trpA genes or trypE, trypD, trypC, trypF, trypB, and trpA genes, nucleic acid sequence encoding kynureninase, and optionally may comprise a deleted or mutated tryptophan repressor (trpR) and/or optionally comprise gene sequence(s) to produce the tryptophan precursor, Chorismate, e.g., sequence(s) encoding aroG, aroF, aroH, aroB, aroD, aroE, aroK, and AroC. In a specific embodiment, the genetically engineered bacteria comprise nucleic acid sequence encoding IL-2, nucleic acid sequence encoding trypE, trypG-D, trypC-F, trypB, and trpA genes, and nucleic acid sequence encoding kynureninase. In a specific embodiment, the genetically engineered bacteria comprise nucleic acid sequence encoding IL-2, nucleic acid sequence encoding trypE, trypG-D, trypC-F, trypB, and trpA genes, nucleic acid sequence encoding kynureninase, nucleic acid sequence encoding aroG, aroF, aroH, aroB, aroD, aroE, aroK, and AroC genes, and optionally deleted or mutated tryptophan repressor (trpR). In another specific embodiment, the genetically engineered bacteria comprise nucleic acid sequence encoding IL-15, nucleic acid sequence encoding trypE, trypG-D, trypC-F, trypB, and trpA genes, and nucleic acid sequence encoding kynureninase. In another specific embodiment, the genetically engineered bacteria comprise nucleic acid sequence encoding IL-12, nucleic acid sequence encoding trypE, trypG-D, trypC-F, trypB, and trpA genes, and nucleic acid sequence encoding kynureninase. In another specific embodiment, the genetically engineered bacteria comprise nucleic acid sequence encoding a CD40 agonist, nucleic acid sequence encoding trypE, trypG-D, trypC-F, trypB, and trpA genes, and nucleic acid sequence encoding kynureninase. In another specific embodiment, the genetically engineered bacteria comprise nucleic acid sequence encoding IL-2, a CD40 agonist, nucleic acid sequence encoding trypE, trypG-D, trypC-F, trypB, and trpA genes, and nucleic acid sequence encoding kynureninase. In any of these embodiments, the tryptophan repressor (trpR) optionally may be deleted, mutated, or modified so as to diminish or obliterate its repressor function. Also, in any of these embodiments, the genetically engineered bacteria optionally comprise gene sequence(s) to produce the tryptophan precursor, Chorismate, e.g., sequence(s) encoding aroG, aroF, aroH, aroB, aroD, aroE, aroK, and AroC. Also, in any of these embodiments, the genetically engineered bacteria may further comprise nucleic acid sequence encoding one or more single-chain antibodies against any checkpoint molecule, for example a checkpoint molecule selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR. Thus, in some embodiments, the genetically engineered bacteria comprise nucleic acid sequence encoding a cytokine, e.g., IL-2 and/or IL-15, nucleic acid sequence encoding trypE, trypG-D, trypC-F, trypB, and trpA genes or trypE, trypD, trypC, trypF, trypB, and trpA genes, nucleic acid encoding kynureninase, and nucleic acid sequence encoding one or more single-chain antibodies against any checkpoint molecule, for example, CTLA-4 and/or PD-1. In one specific embodiment, the genetically engineered bacteria comprise nucleic acid sequence encoding IL-2, nucleic acid sequence encoding trypE, trypG-D, trypC-F, trypB, and trpA genes, nucleic acid encoding kynureninase, and nucleic acid sequence encoding PD-1 or CTLA-4. In one specific embodiment, the genetically engineered bacteria comprise nucleic acid sequence encoding IL-15, nucleic acid sequence encoding trypE, trypG-D, trypC-F, trypB, and trpA genes, nucleic acid encoding kynureninase, and nucleic acid sequence encoding PD-1 or CTLA-4.

In any of the above combination embodiments, the engineered microorganisms are also capable of depleting adenosine from the tumor site. In any of the above combination embodiments, the bacterium comprises one or more gene(s) or a gene cassette comprising one or more genes for depleting adenosine from the intratumoral site. In any of the above combination embodiments, the bacterium comprises a gene cassette comprising one or more genes for converting adenosine to urate. In any of the above combination embodiments, the genetically engineered bacterium comprises gene sequence(s) encoding one or more copies of add, xapA, deoD, xdhA, xdhB, and xdhC genes. In any of the above combination embodiments, the bacterium comprises gene sequence(s) encoding a transporter for importing adenosine into the bacterium. In any of the above combination embodiments, the bacterium comprises gene sequence(s) for encoding a nucleoside transporter, e.g., an adenosine transporter. In any of the above combination embodiments, the genetically engineered bacterium comprises gene sequence(s) for encoding one or more copies of nupG or nupC from *E. coli*. In any of the above combination embodiments, the bacterium comprises one or more gene(s) or a gene cassette comprising one or more biosynthetic genes for synthesizing arginine. In any of the above combination embodiments, the bacterium comprises gene sequence(s) encoding one or more arginine biosynthesis genes selected from argA, argB, argC, argD, argE, argF, argG, argH, argI, argJ, carA, and carB. In any of the above combination embodiments for producing arginine, an arginine repressor (argR) is deleted, mutated, or modified so as to diminish or obliterate its repressor function. In any of the above combination embodiments for producing arginine, the bacterium comprises a gene encoding feedback resistant argA. In any of the above combination embodiments, the genetically engineered bacterium produce a cytotoxin or a lytic peptide.

In some embodiments, the genetically engineered bacteria are capable of metabolizing kynurenine and also producing one or more cytokines. In some embodiments, the genetically engineered bacteria comprise nucleic acid sequence encoding kynureninase and nucleic acid sequence(s) encoding one or more cytokines. In some embodiments kynureninase is from *Pseudomonas fluorescens*. In some embodiments, the genetically engineered bacteria comprise nucleic acid sequence encoding kynureninase (e.g. from *Pseudomonas fluorescens*) and nucleic acid sequence(s) encoding IL-15. In some embodiments, the genetically engineered bacteria comprising nucleic acid sequence(s) encoding kynureninase (e.g. from *Pseudomonas fluorescens*) and nucleic acid sequence(s) encoding IL-15 further comprise one or more antibodies, e.g., scFv antibodies. In some embodiments, the genetically engineered bacteria comprising nucleic acid sequence(s) encoding kynureninase (e.g. from *Pseudomonas fluorescens*) and nucleic acid sequence(s) encoding IL-15 further comprise one or more PD-1 antibodies, e.g., scFV antibodies. In some embodiments, the genetically engineered bacteria comprising nucleic acid sequence(s) encoding kynureninase (e.g. from *Pseudomonas fluorescens*) and nucleic acid sequence(s) encoding IL-15 further comprise one or more PD-L1 antibodies, e.g., scFV antibodies. Exemplary anti-PD1 antibodies and PD-L1 antibodies from which an scFv can be derived are described herein.

In some embodiments, the genetically engineered bacteria comprise nucleic acid sequence encoding kynureninase and nucleic acid sequence(s) encoding one or more cytokines. In some embodiments, such genetically engineered bacteria further comprise tryptophan production gene sequences. In a non-limiting example, such tryptophan sequences (gene cassettes) comprises one or more of trpE, trpD, trpC, trpB, trpA, aroG, aroF, aroH, aroB, aroD, aroE, aroK, and aroC or a combination thereof. In another non-limiting example, such tryptophan production gene sequences comprise one or more of aroG(fbr), trpE(fbr), trpD, trpC, trpB, trpA and combinations thereof. In another non-limiting example, such tryptophan production sequences comprise one or more of aroG(fbr), serA(fbr), trpE(fbr), trpD, trpC, trpB, trpA or combinations thereof. In another non-limiting example, such tryptophan production sequences comprise aroG(fbr), serA(fbr), trpE(fbr), trpD, trpC, trpB, trpA, YddG or combinations thereof. In another non-limiting example such sequences comprise trpE, trpD, trpC, trpB, trpA and combinations thereof. In some embodiments, such genetically engineered bacteria further comprise one or more PD-L1 antibodies, e.g., scFV antibodies. Exemplary anti-PD1 antibodies and PD-L1 antibodies from which an scFv can be derived are described herein.

In any of the above combination embodiments, the bacterium comprises a gene cassette comprising one or more genes for converting adenosine to urate and further comprises gene sequences for the production and secretion of anti-CD40 antibodies (e.g., scFv antibodies). Exemplary anti-CD40 antibodies antibodies from which an scFv can be derived are described herein. In some embodiments, the genetically engineered bacterium comprises gene sequence(s) encoding one or more copies of add, xapA, deoD, xdhA, xdhB, and xdhC and nupC genes, and further comprises gene sequences for the production and secretion of anti-CD40 antibodies. In some embodiments, the genetically engineered bacterium comprises gene sequence(s) encoding one or more copies of add, xapA, deoD, xdhA, xdhB, and xdhC and nupG genes, and further comprises gene sequences for the production and secretion of anti-CD40 antibodies. Suitable secretion tags and other sequences for the secretion of such antibodies are described herein.

In some embodiments, the genetically engineered bacterium comprises gene sequence(s) encoding one or more copies of add, xapA, deoD, xdhA, xdhB, and xdhC and nupC genes, and further comprises gene sequences for the production and surface display of anti-CD40 antibodies. In some embodiments, the genetically engineered bacterium comprises gene sequence(s) encoding one or more copies of add, xapA, deoD, xdhA, xdhB, and xdhC and nupG genes, and further comprises gene sequences for the production and surface display of anti-CD40 antibodies. Suitable membrane display anchors and other sequences for the surface display of such antibodies are described herein.

In one embodiments, the bacterium comprises gene sequence(s) encoding one or more arginine biosynthesis genes and gene sequence(s) encoding one or more antibodies. In one embodiments, the bacterium comprises gene sequence(s) encoding one or more arginine biosynthesis genes and gene sequence(s) encoding one or more anti-CD47 antibodies. In some embodiments, the genetically engineered bacteria comprising the arginine synthesis genes comprise gene sequences for the secretion of one or more anti-CD47 antibodies. In some embodiments, the genetically engineered bacteria comprising the arginine synthesis genes comprise gene sequences for the surface display of one or more anti-CD47 antibodies. In some embodiments, the genetically engineered bacteria comprise one or more gene sequence for the secretion and/or surface display or one or more anti-CD47 antibodies and further comprise one or more arginine biosynthesis genes selected from argA, argB, argC, argD, argE, argF, argG, argH, argI, argJ, carA, and carB. In some embodiments for producing arginine and anti-CD47, an arginine repressor (argR) is deleted, mutated, or modified so as to diminish or obliterate its repressor function. In some embodiments for the production on anti-CD47 and arginine biosynthesis, the bacterium further comprises a gene encoding feedback resistant argA.

In some embodiments, the two or more gene sequence(s) for producing the anti-cancer molecule combinations are operably linked to one or more directly or indirectly inducible promoter(s). In some embodiments, the two or more gene sequence(s) are operably linked to a directly or indirectly inducible promoter that is induced under exogenous environmental conditions, e.g., conditions found in the gut, the tumor microenvironment or other tissue specific conditions. In some embodiments, the two or more gene sequence(s) are operably linked to a directly or indirectly inducible promoter that is induced by metabolites found in the gut, the tumor microenvironment or other specific conditions. In some embodiments, the two or more gene sequence(s) are operably linked to a directly or indirectly inducible promoter that is induced under low-oxygen or anaerobic conditions. In some embodiments, the two or more gene sequence(s) are operably linked to a directly or indirectly inducible promoter that is induced under inflammatory conditions (e.g., RNS, ROS), as described herein. In some embodiments, the two or more gene sequence(s) are operably linked to a directly or indirectly inducible promoter that is induced under immunosuppressive conditions, e.g., as found in the tumor, as described herein. In some embodiments, the two or more gene sequence(s) are linked to a directly or indirectly inducible promoter that is induced by exposure a chemical or nutritional inducer, which may or may not be present under in vivo conditions and which may be present during in vitro conditions (such as strain culture, expansion, manufacture), such as tetracycline or arabinose, or others described herein. In some embodiments, the two or more payloads are all linked to a constitutive promoter. Such constitutive promoters are described in Table 48-Table 58 herein. In some embodiments, the two or more gene sequence are operably linked to the same promoter sequences. In some embodiments, the two or more gene sequence are operably linked to two or more different promoter sequences, which can either all be constitutive (same or different constitutive promoters), all inducible (by same or different inducers), or a mix of constitutive and inducible promoters.

In any of the above combination embodiments, the gene sequence(s) for producing the one or more anti-cancer molecules and operatively linked promoter are present on a chromosome in the bacterium. In any of the above combination embodiments, the gene sequence(s) for producing the one or more anti-cancer molecules and operatively linked promoter are present on a plasmid in the bacterium. In any of the above combination embodiments the bacterium is an auxotroph comprising a deletion or mutation in a gene required for cell survival and/or growth, e.g., wherein the gene is selected from thyA, dapD, and dapA. In any of the above combination embodiment, the genetically engineered bacterium comprises a kill switch.

In some embodiments, the genetically engineered OVs express any of the combinations described above.

In any of the embodiments described in this section in which the genetically engineered bacteria are capable of producing one or more immune modulators that activate, stimulate, and/or induce the differentiation of T effector cells, e.g., CD4+ and CD8+ cells and/or are capable of producing one or more immune modulators that inhibit immune suppressors molecules, e.g., immune checkpoints and Tregs, the genetically engineered bacteria may further be capable of producing a lytic peptide molecule. In some embodiments, the genetically engineered bacteria comprise sequence encoding one or more lytic peptide molecules, selected from D-peptide A, D-peptide B, D-peptide C, D-peptide D, DK6L9, NRC-03, NRC-07, Gomesin, Hepcidin TH2-3, Dermaseptin B2, PTP7, MGA2, HNP-1, Tachyplesin, Temporin-10Ea, NK-2, Bovine lactoferrin B6, Cecropin CB1, Polybia-MPI, SVS-1, Epinecidin-1, D-K6L9, MPI-1, A9K, Hectate, Phor14, Phor21, BEPTII, BEPTII-I, TfR-lytic peptide, BPC96, RGD-Tachyplesin, A9K, ERα17p, CR1166, peptide aptamers, Pentastatin-1, chemokinostatin-1, properdistatin, Myristoyl-Cys-Ala-Val-Ala-Tyr-(1,3 dimethyl)His-OMe, 9 somatostain peptide analogues, and LTX-401.

In some embodiments, the genetically engineered microorganisms encode one or more cassettes which produce GM_CSF, CpG-rich oligo-nucleotide, and tumor cell lysates or antigens derived therefrom, as described in Ali et al. *Sci Transl Med* 1, 8ra19 (2009) In Situ Regulation of DC Subsets and T Cells Mediates Tumor Regression in Mice, the contents of which is herein incorporated by reference in its entirety.

In any of the embodiments described in this section in which the genetically engineered bacteria are capable of producing one or more immune modulators that activate, stimulate, and/or induce the differentiation of T effector cells, e.g., CD4+ and CD8+ cells and/or are capable of producing one or more immune modulators that inhibit immune suppressors molecules, e.g., immune checkpoints and Tregs, the genetically engineered bacteria may further be capable of producing one or more tumor antigens, such as any of the tumor antigens described herein or otherwise known in the art.

In some embodiments, the genetically engineered bacteria of the invention produce the anti-cancer molecule under low-oxygen conditions and are capable of reducing cell proliferation, tumor growth, and/or tumor volume by at least about 10%, 20%, 25%, 30%, 40%, 50%, 60%, 70%, 75%, 80%, 85%, 90%, 95%, or more as compared to an unmodified bacteria of the same subtype under the same conditions.

In some embodiments, the genetically engineered bacteria express the gene for producing the anti-cancer molecule on a plasmid and/or a chromosome. The gene or gene cassettes for producing the anti-cancer molecule may be integrated into the bacterial chromosome at one or more integration sites. For example, one or more copies of the sequence encoding the anti-cancer molecule may be integrated into the bacterial chromosome. Having multiple copies of the gene encoding the anti-cancer molecule integrated into the chromosome allows for greater production of the molecule and also permits fine-tuning of the level of expression. Alternatively, different circuits described herein, such as any of the kill switch circuits, in addition to the gene encoding the anti-cancer molecule could be integrated into the bacterial chromosome at one or more different integration sites to perform multiple different functions. Multiple distinct anti-cancer molecules may be produced by the genetically engineered bacteria.

Any of the described combinations of immunemodulators or anti-cancer molecules described for engineered bacteria can be applied to engineered oncolytic viruses.

In any of these embodiments described herein, a combination of engineered bacteria and engineered oncolytic virus can be used. In any of these embodiments, a combination of engineered bacteria and/or engineered oncolytic virus can be used in conjunction with conventional cancer therapies, such as surgery, chemotherapy, targeted therapies, radiation therapy, tomotherapy, immunotherapy, cancer vaccines, hormone therapy, hyperthermia, stem cell transplant (peripheral blood, bone marrow, and cord blood transplants), photodynamic therapy, therapy, and blood product donation and transfusion. In any of these embodiments for producing an anti-cancer molecule, e.g., an immune inhibitor (antibody), agonistic antibody, agonist antibody, and/or immunostimulatory cytokine, a combination of engineered bacteria and/or engineered oncolytic virus can be used in conjunction with other conventional immunotherapies used to treat cancer, such as Fc-mediated ADCC, BiTE, TCR, adoptive cell therapy (TILs, CARs, NK/NKT, etc), and any of the other immunotherapies described herein and otherwise known in the art. In any of these embodiments, the engineered bacteria and/or engineered oncolytic virus can produce one or more cytotoxins or lytic peptides. In any of these embodiments, the engineered bacteria and/or engineer oncolytic virus can be used in conjunction with a cancer or tumor vaccine.

Regulating Expression of Anti-Cancer Molecules

In some embodiments, the bacterial cell comprises a stably maintained plasmid or chromosome carrying the gene(s) encoding payload (s), such that the payload(s) can be expressed in the host cell, and the host cell is capable of survival and/or growth in vitro, e.g., in medium, and/or in vivo, e.g., in the gut or in the tumor microenvironment. In some embodiments, bacterial cell comprises two or more distinct payloads or operons, e.g., two or more payload genes. In some embodiments, bacterial cell comprises three or more distinct transporters or operons, e.g., three or more payload genes. In some embodiments, bacterial cell comprises 4, 5, 6, 7, 8, 9, 10, or more distinct payloads or operons, e.g., 4, 5, 6, 7, 8, 9, 10, or more payload genes.

Herein the terms "payload" "polypeptide of interest" or "polypeptides of interest", "protein of interest", "proteins of interest", "payloads" "effector molecule", "effector" refers to one or more effector molecules described herein and/or one or more enzyme(s) or polypeptide(s0 function as enyzmes for the production of such effector molecules. Non-limiting examples of payloads include IL-12, IL-2, IL-15, IL-18, IL-7, IL-21, CD40 agonist, CD40 agonist, CD226 agonist, CD137 agonist, ICOS agonist, OX040 agonist, GM-CSF, antibodies, e.g., scFvs, including but not limited to checkpoint inhibitors (e.g., PD1, PDL1, CTLA4, anti-LAGS, anti-TIM3 and others described herein), kynureninase, one or more tryptophan and/or arginine production enzymes, adenosine degradation enzymes. As used herein, the term "polypeptide of interest" or "polypeptides of interest", "protein of interest", "proteins of interest", "payload", "payloads" further includes any or a plurality of any of the tryptophan synthesis enzymes, kynurenine degrading enzymes, adenosine degrading enzymes, arginine producing enzymes, and other metabolic pathway enzymes described herein. As used herein, the term "gene of interest" or "gene sequence of interest" includes any or a plurality of any of the gene(s) an/or gene sequence(s) and or gene cassette(s) encoding one or more anti-cancer molecule(s) described herein.

In some embodiments, the genetically engineered bacteria comprise multiple copies of the same payload gene(s). In some embodiments, the gene encoding the payload is present on a plasmid and operably linked to a directly or indirectly inducible promoter. In some embodiments, the gene encoding the payload is present on a plasmid and operably linked to a constitutive promoter. In some embodiments, the gene encoding the payload is present on a plasmid and operably linked to a promoter that is induced under low-oxygen or anaerobic conditions. In some embodiments, the gene encoding the payload is present on plasmid and operably linked to a promoter that is induced by exposure to tetracycline or arabinose, or another chemical or nutritional inducer described herein.

In some embodiments, the gene encoding the payload is present on a chromosome and operably linked to a directly or indirectly inducible promoter. In some embodiments, the gene encoding the payload is present on a chromosome and operably linked to a constitutive promoter. In some embodiments, the gene encoding the payload is present in the chromosome and operably linked to a promoter that is induced under low-oxygen or anaerobic conditions. In some embodiments, the gene encoding the payload is present on chromosome and operably linked to a promoter that is induced by exposure to tetracycline or arabinose, or another chemical or nutritional inducer described herein.

In some embodiments, the genetically engineered bacteria comprise two or more payloads, all of which are present on the chromosome. In some embodiments, the genetically engineered bacteria comprise two or more payloads, all of which are present on one or more same or different plasmids. In some embodiments, the genetically engineered bacteria comprise two or more payloads, some of which are present on the chromosome and some of which are present on one or more same or different plasmids.

In any of the nucleic acid embodiments described above, the one or more payload(s) for producing the anti-cancer molecule combinations are operably linked to one or more directly or indirectly inducible promoter(s). In some embodiments, the one or more payload(s) are operably linked to a directly or indirectly inducible promoter that is induced under exogenous environmental conditions, e.g., conditions found in the gut, the tumor microenvironment or other tissue specific conditions. In some embodiments, the one or more payload(s) are operably linked to a directly or indirectly inducible promoter that is induced by metabolites found in the gut, the tumor microenvironment or other specific conditions. In some embodiments, the one or more payload(s) are operably linked to a directly or indirectly inducible promoter that is induced under low-oxygen or anaerobic conditions. In some embodiments, the one or more payload(s) are operably linked to a directly or indirectly inducible promoter that is induced under inflammatory conditions (e.g., RNS, ROS), as described herein. In some embodiments, the one or more payload(s) are operably linked to a directly or indirectly inducible promoter that is induced under immunosuppressive conditions, e.g., as found in the tumor, as described herein. In some embodiments, the two or more gene sequence(s) are linked to a directly or indirectly inducible promoter that is induced by exposure a chemical or nutritional inducer, which may or may not be present under in vivo conditions and which may be present during in vitro conditions (such as strain culture, expansion, manufacture), such as tetracycline or arabinose, or others described herein. In some embodiments, the two or more payloads are all linked to a constitutive promoter. Such constitutive promoters are described in Table 48-Table 58 herein.

In some embodiments, the promoter is induced under in vivo conditions, e.g., the gut, as described herein. In some embodiments, the promoters is induced under in vitro conditions, e.g., various cell culture and/or cell manufacturing conditions, as described herein. In some embodiments, the promoter is induced under in vivo conditions, e.g., the gut, as described herein, and under in vitro conditions, e.g., various cell culture and/or cell production and/or manufacturing conditions, as described herein.

In some embodiments, the promoter that is operably linked to the gene encoding the payload is directly induced by exogenous environmental conditions (e.g., in vivo and/or in vitro and/or production/manufacturing conditions). In some embodiments, the promoter that is operably linked to the gene encoding the payload is indirectly induced by exogenous environmental conditions (e.g., in vivo and/or in vitro and/or production/manufacturing conditions).

In some embodiments, the promoter is directly or indirectly induced by exogenous environmental conditions specific to the gut of a mammal. In some embodiments, the promoter is directly or indirectly induced by exogenous environmental conditions specific to the hypoxic environment of a tumor and/or the small intestine of a mammal. In some embodiments, the promoter is directly or indirectly induced by low-oxygen or anaerobic conditions such as the hypoxic environment of a tumor and/or the environment of the mammalian gut. In some embodiments, the promoter is directly or indirectly induced by molecules or metabolites that are specific to the tumor, a particular tissue or the gut of a mammal. In some embodiments, the promoter is directly or indirectly induced by a molecule that is co-administered with the bacterial cell.

FNR Dependent Regulation

The genetically engineered bacteria of the invention comprise a gene or gene cassette for producing anti-cancer molecule, wherein the gene or gene cassette is operably linked to a directly or indirectly inducible promoter that is controlled by exogenous environmental condition(s). In some embodiments, the inducible promoter is an oxygen level-dependent promoter and anti-cancer molecule is expressed in low-oxygen, microaerobic, or anaerobic conditions. For example, in low oxygen conditions, the oxygen level-dependent promoter is activated by a corresponding oxygen level-sensing transcription factor, thereby driving production of anti-cancer molecule.

Bacteria have evolved transcription factors that are capable of sensing oxygen levels. Different signaling pathways may be triggered by different oxygen levels and occur with different kinetics. An oxygen level-dependent promoter is a nucleic acid sequence to which one or more oxygen level-sensing transcription factors is capable of binding, wherein the binding and/or activation of the corresponding transcription factor activates downstream gene expression. In one embodiment, the genetically engineered bacteria comprise a gene or gene cassette for producing a payload under the control of an oxygen level-dependent promoter. In a more specific aspect, the genetically engineered bacteria comprise a gene or gene cassette for producing a payload under the control of an oxygen level-dependent promoter that is activated under low-oxygen or anaerobic environments, such as the hypoxic environment of a tumor and/or the environment of the mammalian gut.

In certain embodiments, the bacterial cell comprises a gene encoding a payload expressed under the control of a fumarate and nitrate reductase regulator (FNR) responsive promoter. In E. coli, FNR is a major transcriptional activator that controls the switch from aerobic to anaerobic metabolism (Unden et al., 1997). In the anaerobic state, FNR dimerizes into an active DNA binding protein that activates hundreds of genes responsible for adapting to anaerobic growth. In the aerobic state, FNR is prevented from dimerizing by oxygen and is inactive. FNR responsive promoters include, but are not limited to, the FNR responsive promoters listed in Table 37 and Table 38 below. Underlined sequences are predicted ribosome binding sites, and bolded sequences are restriction sites used for cloning.

TABLE 37

FNR Promoter Sequences

| FNR Responsive Promoter | Sequence |
|---|---|
| SEQ ID NO: 563 | GTCAGCATAACACCCTGACCTCTCATTAATTGTTCATGCCGGGCGGCA<br>CTATCGTCGTCCGGCCTTTTCCTCTCTTACTCTGCTACGTACATCTATTT<br>CTATAAATCCGTTCAATTTGTCTGTTTTTTGCACAAACATGAAATATCA<br>GACAATTCCGTGACTTAAGAAAATTTATACAAATCAGCAATATACCCC<br>TTAAGGAGTATATAAAGGTGAATTTGATTTACATCAATAAGCGGGGTT<br>GCTGAATCGTTAAGGTAGGCGGTAATAG<u>AAAAGAAATCGAGGCAAAA</u> |
| SEQ ID NO: 564 | ATTTCCTCTCATCCCATCCGGGGTGAGAGTCTTTTCCCCCGACTTATGG<br>CTCATGCATGCATCAAAAAAGATGTGAGCTTGATCAAAAACAAAAAA<br>TATTTCACTCGACAGGAGTATTTATATTGCGCCCGTTACGTGGGCTTCG<br>ACTGTAAATC<u>AGAAAGGAGAAAACACCT</u> |
| SEQ ID NO: 565 | GTCAGCATAACACCCTGACCTCTCATTAATTGTTCATGCCGGGCGGCA<br>CTATCGTCGTCCGGCCTTTTCCTCTCTTACTCTGCTACGTACATCTATTT<br>CTATAAATCCGTTCAATTTGTCTGTTTTTTGCACAAACATGAAATATCA<br>GACAATTCCGTGACTTAAGAAAATTTATACAAATCAGCAATATACCCC<br>TTAAGGAGTATATAAAGGTGAATTTGATTTACATCAATAAGCGGGGTT<br>GCTGAATCGTTAAGGATCC<u>CTAGAAATAATTTTGTTTAACTTTAAG</u><br><u>AAGGAGATATACAT</u> |
| SEQ ID NO: 566 | CATTTCCTCTCATCCCATCCGGGGTGAGAGTCTTTTCCCCCGACTTATG<br>GCTCATGCATGCATCAAAAAGATGTGAGCTTGATCAAAAACAAAAA<br>ATATTTCACTCGACAGGAGTATTTATATTGCGCCCGGATCC<u>CTCTAGA</u><br><u>AATAATTTTGTTTAACTTTAAGAAGGAGATATACAT</u> |

TABLE 37-continued

FNR Promoter Sequences

| FNR Responsive Promoter | Sequence |
|---|---|
| SEQ ID NO: 567 | AGTTGTTCTTATTGGTGGTGTTGCTTTATGGTTGCATCGTAGTAAATGG<br>TTGTAACAAAAGCAATTTTTCCGGCTGTCTGTATACAAAAACGCCGTA<br>AAGTTTGAGCGAAGTCAATAAACTCTCTACCCATTCAGGGCAATATCT<br>CTCTTGGATCCCTCTAGAAATAATTTTGTTTAACTTTAAGAAGGAGAT<br>ATACAT |

TABLE 38

FNR Promoter sequences

| FNR-responsive regulatory region | 12345678901234567890123456789012345678901234567890 |
|---|---|
| SEQ ID NO: 568 | ATCCCCATCACTCTTGATGGAGATCAATTCCCCAAGCTGCTAGAGC<br>GTTACCTTGCCCTTAAACATTAGCAATGTCGATTTATCAGAGGGCC<br>GACAGGCTCCCACAGGAGAAAACCG |
| SEQ ID NO: 569 | CTCTTGATCGTTATCAATTCCCACGCTGTTTCAGAGCGTTACCTTGC<br>CCTTAAACATTAGCAATGTCGATTTATCAGAGGGCCGACAGGCTCC<br>CACAGGAGAAAACCG |
| nirB1<br>SEQ ID NO: 570 | GTCAGCATAACACCCTGACCTCTCATTAATTGTTCATGCCGGGCGG<br>CACTATCGTCGTCCGGCCTTTTCCTCTCTTACTCTGCTACGTACATC<br>TATTTCTATAAATCCGTTCAATTTGTCTGTTTTTTGCACAAACATGA<br>AATATCAGACAATTCCGTGACTTAAGAAAATTTATACAAATCAGC<br>AATATACCCCTTAAGGAGTATATAAAGGTGAATTTGATTTACATCA<br>ATAAGCGGGGTTGCTGAATCGTTAAGGTAGGCGGTAATAGAAAAG<br>AAATCGAGGCAAAA |
| nirb2<br>SEQ ID NO: 571 | CGGCCCGATCGTTGAACATAGCGGTCCGCAGGCGGCACTGCTTAC<br>AGCAAACGGTCTGTACGCTGTCGTCTTTGTGATGTGCTTCCTGTTA<br>GGTTTCGTCAGCCGTCACCGTCAGCATAACACCCTGACCTCTCATT<br>AATTGCTCATGCCGGACGGCACTATCGTCGTCCGGCCTTTTCCTCT<br>CTTCCCCCGCTACGTGCATCTATTTCTATAAACCCGCTCATTTTGTC<br>TATTTTTTGCACAAACATGAAATATCAGACAATTCCGTGACTTAAG<br>AAAATTTATACAAATCAGCAATATACCCATTAAGGAGTATATAAA<br>GGTGAATTTGATTTACATCAATAAGCGGGGTGCTGAATCGTTAAG<br>GTAGGCGGTAATAGAAAAGAAATCGAGGCAAAAatgtttgtttaactttaagaa<br>ggagatatacat |
| nirB3<br>SEQ ID NO: 572 | GTCAGCATAACACCCTGACCTCTCATTAATTGCTCATGCCGGACGG<br>CACTATCGTCGTCCGGCCTTTTCCTCTCTTCCCCCGCTACGTGCATC<br>TATTTCTATAAACCCGCTCATTTTGTCTATTTTTTGCACAAACATGA<br>AATATCAGACAATTCCGTGACTTAAGAAAATTTATACAAATCAGC<br>AATATACCCATTAAGGAGTATATAAAGGTGAATTTGATTTACATCA<br>ATAAGCGGGGTTGCTGAATCGTTAAGGTAGGCGGTAATAGAAAAG<br>AAATCGAGGCAAAA |
| ydfZ<br>SEQ ID NO: 573 | ATTTCCTCTCATCCCATCCGGGGTGAGAGTCTTTTCCCCCGACTTAT<br>GGCTCATGCATGCATCAAAAAGATGTGAGCTTGATCAAAAACAA<br>AAAATATTTCACTCGACAGGAGTATTTATATTGCGCCCGTTACGTG<br>GGCTTCGACTGTAAATC<u>AGAAAGGAGAAAACACCT</u> |
| nirB + RBS<br>SEQ ID NO: 574 | GTCAGCATAACACCCTGACCTCTCATTAATTGTTCATGCCGGGCGG<br>CACTATCGTCGTCCGGCCTTTTCCTCTCTTACTCTGCTACGTACATC<br>TATTTCTATAAATCCGTTCAATTTGTCTGTTTTTTGCACAAACATGA<br>AATATCAGACAATTCCGTGACTTAAGAAAATTTATACAAATCAGC<br>AATATACCCCTTAAGGAGTATATAAAGGTGAATTTGATTTACATCA<br>ATAAGCGGGGTTGCTGAATCGTTAAGGATCC<u>CTCTAGAAATAATT<br>TTGTTTAACTTTAAGAAGGAGATATACAT</u> |
| ydfZ + RBS<br>SEQ ID NO: 575 | CATTTCCTCTCATCCCATCCGGGGTGAGAGTCTTTTCCCCCGACTTA<br>TGGCTCATGCATGCATCAAAAAGATGTGAGCTTGATCAAAAACA<br>AAAAATATTTCACTCGACAGGAGTATTTATATTGCGCCCGGATCC<br><u>CTCTAGAAATAATTTTGTTTAACTTTAAGAAGGAGATATACAT</u> |
| fnrS1<br>SEQ ID NO: 576 | AGTTGTTCTTATTGGTGGTGTTGCTTTATGGTTGCATCGTAGTAAAT<br>GGTTGTAACAAAAGCAATTTTTCCGGCTGTCTGTATACAAAAACGC<br>CGTAAAGTTTGAGCGAAGTCAATAAACTCTCTACCCATTCAGGGC<br>AATATCTCTCTTGGATCC<u>CTCTAGAAATAATTTTGTTTAACTTTAA<br>GAAGGAGATATACAT</u> |

TABLE 38-continued

FNR Promoter sequences

| FNR-responsive regulatory region | 123456789012345678901234567890123456789012345678 90 |
|---|---|
| fnrS2<br>SEQ ID NO: 577 | AGTTGTTCTTATTGGTGGTGTTGCTTTATGGTTGCATCGTAGTAAAT<br>GGTTGTAACAAAAGCAATTTTTCCGGCTGTCTGTATACAAAAACGC<br>CGCAAAGTTTGAGCGAAGTCAATAAACTCTCTACCCATTCAGGGC<br>AATATCTCTCTT<u>GGATCCAAAGTGAACTCTAGAAATAATTTTGTTT</u><br><u>AACTTTAAGAAGGAGATATACAT</u> |
| nirB + crp<br>SEQ ID NO: 578 | TCGTCTTTGTGATGTGCTTCCTGTTAGGTTTCGTCAGCCGTCACCGT<br>CAGCATAACACCCTGACCTCTCATTAATTGCTCATGCCGGACGGCA<br>CTATCGTCGTCCGGCCTTTTCCTCTCTTCCCCCGCTACGTGCATCTA<br>TTTCTATAAACCCGCTCATTTTGTCTATTTTTTGCACAAACATGAAA<br>TATCAGACAATTCCGTGACTTAAGAAAATTTATACAAATCAGCAAT<br>ATACCCATTAAGGAGTATATAAAGGTGAATTTGATTTACATCAATA<br>AGCGGGGTTGCTGAATCGTTAAGGTAGaaatgtgatctagttcacatttGCGGTA<br>ATAGAAAAGAAATCGAGGCAAAAatgtttgtttaactttaagaaggagatatacat |
| fnrS + crp<br>SEQ ID NO: 579 | AGTTGTTCTTATTGGTGGTGTTGCTTTATGGTTGCATCGTAGTAAAT<br>GGTTGTAACAAAAGCAATTTTTCCGGCTGTCTGTATACAAAAACGC<br>CGCAAAGTTTGAGCGAAGTCAATAAACTCTCTACCCATTCAGGGC<br>AATATCTCTCaaatgtgatctagttcacattttttgtttaactttaagaaggagatatacat |

FNR promoter sequences are known in the art, and any suitable FNR promoter sequence(s) may be used in the genetically engineered bacteria of the invention. Any suitable FNR promoter(s) may be combined with any suitable payload.

Non-limiting FNR promoter sequences are provided in Table 37 and Table 38. Table 37 and Table 38 depicts the nucleic acid sequences of exemplary regulatory region sequences comprising a FNR-responsive promoter sequence. Underlined sequences are predicted ribosome binding sites, and bolded sequences are restriction sites used for cloning. In some embodiments, the genetically engineered bacteria of the invention comprise one or more of: SEQ ID NO: 563, SEQ ID NO: 564, SEQ ID NO: 565, SEQ ID NO: 566, SEQ ID NO: 567, SEQ ID NO: 568, SEQ ID NO: 569, nirB1 promoter (SEQ ID NO: 570), nirB2 promoter (SEQ ID NO: 571), nirB3 promoter (SEQ ID NO: 572), ydfZ promoter (SEQ ID NO: 573), nirB promoter fused to a strong ribosome binding site (SEQ ID NO: 574), ydfZ promoter fused to a strong ribosome binding site (SEQ ID NO: 575), fnrS, an anaerobically induced small RNA gene (fnrS1 promoter SEQ ID NO: 576 or fnrS2 promoter SEQ ID NO: 577), nirB promoter fused to a crp binding site (SEQ ID NO: 578), and fnrS fused to a crp binding site (SEQ ID NO: 579). In some embodiments, the FNR-responsive promoter is at least about 80%, at least about 85%, at least about 90%, at least about 95%, or at least about 99% homologous to the sequence of any one of SEQ ID NOs: 563-579.

In some embodiments, multiple distinct FNR nucleic acid sequences are inserted in the genetically engineered bacteria. In alternate embodiments, the genetically engineered bacteria comprise a gene encoding a payload expressed under the control of an alternate oxygen level-dependent promoter, e.g., DNR (Trunk et al., 2010) or ANR (Ray et al., 1997). In these embodiments, expression of the payload gene is particularly activated in a low-oxygen or anaerobic environment, such as in the gut. In some embodiments, gene expression is further optimized by methods known in the art, e.g., by optimizing ribosomal binding sites and/or increasing mRNA stability. In one embodiment, the mammalian gut is a human mammalian gut.

In another embodiment, the genetically engineered bacteria comprise the gene or gene cassette for producing anti-cancer molecule expressed under the control of anaerobic regulation of arginine deiminiase and nitrate reduction transcriptional regulator (ANR). In P. aeruginosa, ANR is "required for the expression of physiological functions which are inducible under oxygen-limiting or anaerobic conditions" (Winteler et al., 1996; Sawers 1991). P. aeruginosa ANR is homologous with E. coli FNR, and "the consensus FNR site (TTGAT- - - -ATCAA) was recognized efficiently by ANR and FNR" (Winteler et al., 1996). Like FNR, in the anaerobic state, ANR activates numerous genes responsible for adapting to anaerobic growth. In the aerobic state, ANR is inactive. Pseudomonas fluorescens, Pseudomonas putida, Pseudomonas syringae, and Pseudomonas mendocina all have functional analogs of ANR (Zimmermann et al., 1991). Promoters that are regulated by ANR are known in the art, e.g., the promoter of the arcDABC operon (see, e.g., Hasegawa et al., 1998).

In other embodiments, the one or more gene sequence(s) for producing a payload are expressed under the control of an oxygen level-dependent promoter fused to a binding site for a transcriptional activator, e.g., CRP. CRP (cyclic AMP receptor protein or catabolite activator protein or CAP) plays a major regulatory role in bacteria by repressing genes responsible for the uptake, metabolism, and assimilation of less favorable carbon sources when rapidly metabolizable carbohydrates, such as glucose, are present (Wu et al., 2015). This preference for glucose has been termed glucose repression, as well as carbon catabolite repression (Deutscher, 2008; Görke and Stülke, 2008). In some embodiments, the gene or gene cassette for producing an anti-cancer molecule is controlled by an oxygen level-dependent promoter fused to a CRP binding site. In some embodiments, the one or more gene sequence(s) for a payload are controlled by a FNR promoter fused to a CRP binding site. In these embodiments, cyclic AMP binds to CRP when no glucose is present in the environment. This binding causes a conformational change in CRP, and allows CRP to bind tightly to its binding site. CRP binding then activates transcription of the gene or gene cassette by recruiting RNA polymerase to the FNR promoter via direct protein-protein interactions. In the presence of glucose, cyclic AMP does not bind to CRP and transcription of the gene or gene cassette for producing an payload is repressed. In some embodiments, an oxygen level-dependent promoter (e.g., an FNR promoter) fused to a binding site for a transcriptional activator is used to ensure that the gene or gene cassette for producing an payload is not expressed under anaerobic conditions when sufficient amounts of glucose are present, e.g., by adding glucose to growth media in vitro.

In some embodiments, the genetically engineered bacteria comprise an oxygen level-dependent promoter from a different species, strain, or substrain of bacteria. In some embodiments, the genetically engineered bacteria comprise an oxygen level-sensing transcription factor, e.g., FNR, ANR or DNR, from a different species, strain, or substrain of bacteria. In some embodiments, the genetically engineered bacteria comprise an oxygen level-sensing transcription factor and corresponding promoter from a different species, strain, or substrain of bacteria. The heterologous oxygen-level dependent transcriptional regulator and/or promoter increases the transcription of genes operably linked to said promoter, e.g., one or more gene sequence(s) for producing the payload(s) in a low-oxygen or anaerobic environment, as compared to the native gene(s) and promoter in the bacteria under the same conditions. In certain embodiments, the non-native oxygen-level dependent transcriptional regulator is an FNR protein from *N. gonorrhoeae* (see, e.g., Isabella et al., 2011). In some embodiments, the corresponding wild-type transcriptional regulator is left intact and retains wild-type activity. In alternate embodiments, the corresponding wild-type transcriptional regulator is deleted or mutated to reduce or eliminate wild-type activity.

In some embodiments, the genetically engineered bacteria comprise a wild-type oxygen-level dependent transcriptional regulator, e.g., FNR, ANR, or DNR, and corresponding promoter that is mutated relative to the wild-type promoter from bacteria of the same subtype. The mutated promoter enhances binding to the wild-type transcriptional regulator and increases the transcription of genes operably linked to said promoter, e.g., the gene encoding the payload, in a low-oxygen or anaerobic environment, as compared to the wild-type promoter under the same conditions. In some embodiments, the genetically engineered bacteria comprise a wild-type oxygen-level dependent promoter, e.g., FNR, ANR, or DNR promoter, and corresponding transcriptional regulator that is mutated relative to the wild-type transcriptional regulator from bacteria of the same subtype. The mutated transcriptional regulator enhances binding to the wild-type promoter and increases the transcription of genes operably linked to said promoter, e.g., the gene encoding the payload, in a low-oxygen or anaerobic environment, as compared to the wild-type transcriptional regulator under the same conditions. In certain embodiments, the mutant oxygen-level dependent transcriptional regulator is an FNR protein comprising amino acid substitutions that enhance dimerization and FNR activity (see, e.g., Moore et al., (2006). In some embodiments, both the oxygen level-sensing transcriptional regulator and corresponding promoter are mutated relative to the wild-type sequences from bacteria of the same subtype in order to increase expression of the payload in low-oxygen conditions.

In some embodiments, the bacterial cells comprise multiple copies of the endogenous gene encoding the oxygen level-sensing transcriptional regulator, e.g., the FNR gene. In some embodiments, the gene encoding the oxygen level-sensing transcriptional regulator is present on a plasmid. In some embodiments, the gene encoding the oxygen level-sensing transcriptional regulator and the gene encoding the payload are present on different plasmids. In some embodiments, the gene encoding the oxygen level-sensing transcriptional regulator and the gene encoding the payload are present on the same plasmid.

In some embodiments, the gene encoding the oxygen level-sensing transcriptional regulator is present on a chromosome. In some embodiments, the gene encoding the oxygen level-sensing transcriptional regulator and the gene encoding the payload are present on different chromosomes. In some embodiments, the gene encoding the oxygen level-sensing transcriptional regulator and the gene encoding the payload are present on the same chromosome. In some instances, it may be advantageous to express the oxygen level-sensing transcriptional regulator under the control of an inducible promoter in order to enhance expression stability. In some embodiments, expression of the transcriptional regulator is controlled by a different promoter than the promoter that controls expression of the gene encoding the payload. In some embodiments, expression of the transcriptional regulator is controlled by the same promoter that controls expression of the payload. In some embodiments, the transcriptional regulator and the payload are divergently transcribed from a promoter region.

RNS-Dependent Regulation

In some embodiments, the genetically engineered bacteria or genetically engineered virus comprise a gene encoding a payload that is expressed under the control of an inducible promoter. In some embodiments, the genetically engineered bacterium or genetically engineered virus that expresses a payload under the control of a promoter that is activated by inflammatory conditions. In one embodiment, the gene for producing the payload is expressed under the control of an inflammatory-dependent promoter that is activated in inflammatory environments, e.g., a reactive nitrogen species or RNS promoter.

As used herein, "reactive nitrogen species" and "RNS" are used interchangeably to refer to highly active molecules, ions, and/or radicals derived from molecular nitrogen. RNS can cause deleterious cellular effects such as nitrosative stress. RNS includes, but is not limited to, nitric oxide (NO.), peroxynitrite or peroxynitrite anion (ONOO—), nitrogen dioxide ($\cdot$NO2), dinitrogen trioxide (N2O3), peroxynitrous acid (ONOOH), and nitroperoxycarbonate (ONOOCO2-) (unpaired electrons denoted by $\cdot$). Bacteria have evolved transcription factors that are capable of sensing RNS levels. Different RNS signaling pathways are triggered by different RNS levels and occur with different kinetics.

As used herein, "RNS-inducible regulatory region" refers to a nucleic acid sequence to which one or more RNS-sensing transcription factors is capable of binding, wherein the binding and/or activation of the corresponding transcription factor activates downstream gene expression; in the presence of RNS, the transcription factor binds to and/or activates the regulatory region. In some embodiments, the RNS-inducible regulatory region comprises a promoter sequence. In some embodiments, the transcription factor senses RNS and subsequently binds to the RNS-inducible regulatory region, thereby activating downstream gene expression. In alternate embodiments, the transcription factor is bound to the RNS-inducible regulatory region in the absence of RNS; in the presence of RNS, the transcription factor undergoes a conformational change, thereby activating downstream gene expression. The RNS-inducible regulatory region may be operatively linked to a gene or genes, e.g., a payload gene sequence(s), e.g., any of the payloads described herein. For example, in the presence of RNS, a transcription factor senses RNS and activates a corresponding RNS-inducible regulatory region, thereby driving expression of an operatively linked gene sequence. Thus, RNS induces expression of the gene or gene sequences.

As used herein, "RNS-derepressible regulatory region" refers to a nucleic acid sequence to which one or more RNS-sensing transcription factors is capable of binding, wherein the binding of the corresponding transcription factor represses downstream gene expression; in the presence of RNS, the transcription factor does not bind to and does not repress the regulatory region. In some embodiments, the RNS-derepressible regulatory region comprises a promoter sequence. The RNS-derepressible regulatory region may be operatively linked to a gene or genes, e.g., a payload gene sequence(s). For example, in the presence of RNS, a transcription factor senses RNS and no longer binds to and/or represses the regulatory region, thereby derepressing an operatively linked gene sequence or gene cassette. Thus, RNS depresses expression of the gene or genes.

As used herein, "RNS-repressible regulatory region" refers to a nucleic acid sequence to which one or more RNS-sensing transcription factors is capable of binding, wherein the binding of the corresponding transcription factor represses downstream gene expression; in the presence of RNS, the transcription factor binds to and represses the regulatory region. In some embodiments, the RNS-repressible regulatory region comprises a promoter sequence. In some embodiments, the transcription factor that senses RNS is capable of binding to a regulatory region that overlaps with part of the promoter sequence. In alternate embodiments, the transcription factor that senses RNS is capable of binding to a regulatory region that is upstream or downstream of the promoter sequence. The RNS-repressible regulatory region may be operatively linked to a gene sequence or gene cassette. For example, in the presence of RNS, a transcription factor senses RNS and binds to a corresponding RNS-repressible regulatory region, thereby blocking expression of an operatively linked gene sequence or gene sequences. Thus, RNS represses expression of the gene or gene sequences.

As used herein, a "RNS-responsive regulatory region" refers to a RNS-inducible regulatory region, a RNS-repressible regulatory region, and/or a RNS-derepressible regulatory region. In some embodiments, the RNS-responsive regulatory region comprises a promoter sequence. Each regulatory region is capable of binding at least one corresponding RNS-sensing transcription factor. Examples of transcription factors that sense RNS and their corresponding RNS-responsive genes, promoters, and/or regulatory regions include, but are not limited to, those shown in Table 39.

TABLE 39

Examples of RNS-sensing transcription factors and RNS-responsive genes

| RNS-sensing transcription factor: | Primarily capable of sensing: | Examples of responsive genes, promoters, and/or regulatory regions: |
|---|---|---|
| NsrR | NO | norB, aniA, nsrR, hmpA, ytfE, ygbA, hcp, hcr, nrfA, aox |
| NorR | NO | norVW, norR |
| DNR | NO | norCB, nir, nor, nos |

In some embodiments, the genetically engineered bacteria of the invention comprise a tunable regulatory region that is directly or indirectly controlled by a transcription factor that is capable of sensing at least one reactive nitrogen species. The tunable regulatory region is operatively linked to a gene or genes capable of directly or indirectly driving the expression of a payload, thus controlling expression of the payload relative to RNS levels. For example, the tunable regulatory region is a RNS-inducible regulatory region, and the payload is a payload, such as any of the payloads provided herein; when RNS is present, e.g., in an inflamed tissue, a RNS-sensing transcription factor binds to and/or activates the regulatory region and drives expression of the payload gene or genes. Subsequently, when inflammation is ameliorated, RNS levels are reduced, and production of the payload is decreased or eliminated.

In some embodiments, the tunable regulatory region is a RNS-inducible regulatory region; in the presence of RNS, a transcription factor senses RNS and activates the RNS-inducible regulatory region, thereby driving expression of an operatively linked gene or genes. In some embodiments, the transcription factor senses RNS and subsequently binds to the RNS-inducible regulatory region, thereby activating downstream gene expression. In alternate embodiments, the transcription factor is bound to the RNS-inducible regulatory region in the absence of RNS; when the transcription factor senses RNS, it undergoes a conformational change, thereby inducing downstream gene expression.

In some embodiments, the tunable regulatory region is a RNS-inducible regulatory region, and the transcription factor that senses RNS is NorR. NorR "is an NO-responsive transcriptional activator that regulates expression of the norVW genes encoding flavorubredoxin and an associated flavoprotein, which reduce NO to nitrous oxide" (Spiro 2006). The genetically engineered bacteria of the invention may comprise any suitable RNS-responsive regulatory region from a gene that is activated by NorR. Genes that are capable of being activated by NorR are known in the art (see, e.g., Spiro 2006; Vine et al., 2011; Karlinsey et al., 2012). In certain embodiments, the genetically engineered bacteria of the invention comprise a RNS-inducible regulatory region from norVW that is operatively linked to a gene or genes, e.g., one or more payload gene sequence(s). In the presence of RNS, a NorR transcription factor senses RNS and activates to the norVW regulatory region, thereby driving expression of the operatively linked gene(s) and producing the payload(s).

In some embodiments, the tunable regulatory region is a RNS-inducible regulatory region, and the transcription factor that senses RNS is DNR. DNR (dissimilatory nitrate respiration regulator) "promotes the expression of the nir, the nor and the nos genes" in the presence of nitric oxide (Castiglione et al., 2009). The genetically engineered bacteria of the invention may comprise any suitable RNS-responsive regulatory region from a gene that is activated by DNR. Genes that are capable of being activated by DNR are known in the art (see, e.g., Castiglione et al., 2009; Giardina et al., 2008). In certain embodiments, the genetically engineered bacteria of the invention comprise a RNS-inducible regulatory region from norCB that is operatively linked to a gene or gene cassette, e.g., a butyrogenic gene cassette. In the presence of RNS, a DNR transcription factor senses RNS and activates to the norCB regulatory region, thereby driving expression of the operatively linked gene or genes and producing one or more payloads. In some embodiments, the DNR is *Pseudomonas aeruginosa* DNR.

In another embodiment, the genetically engineered bacteria comprise the gene or gene cassette for producing anti-cancer molecule expressed under the control of the dissimilatory nitrate respiration regulator (DNR). DNR is a member of the FNR family (Arai et al., 1995) and is a transcriptional regulator that is required in conjunction with ANR for "anaerobic nitrate respiration of *Pseudomonas aeruginosa*" (Hasegawa et al., 1998). For certain genes, the FNR-binding motifs "are probably recognized only by DNR" (Hasegawa et al., 1998). Any suitable transcriptional regulator that is controlled by exogenous environmental conditions and corresponding regulatory region may be used. Non-limiting examples include ArcA/B, ResD/E, NreA/B/C, and AirSR, and others are known in the art.

In some embodiments, the tunable regulatory region is a RNS-derepressible regulatory region, and binding of a corresponding transcription factor represses downstream gene expression; in the presence of RNS, the transcription factor no longer binds to the regulatory region, thereby derepressing the operatively linked gene or gene cassette.

In some embodiments, the tunable regulatory region is a RNS-derepressible regulatory region, and the transcription factor that senses RNS is NsrR. NsrR is "an Rrf2-type transcriptional repressor [that] can sense NO and control the expression of genes responsible for NO metabolism" (Isabella et al., 2009). The genetically engineered bacteria of the invention may comprise any suitable RNS-responsive regulatory region from a gene that is repressed by NsrR. In some embodiments, the NsrR is *Neisseria gonorrhoeae* NsrR. Genes that are capable of being repressed by NsrR are known in the art (see, e.g., Isabella et al., 2009; Dunn et al., 2010). In certain embodiments, the genetically engineered bacteria of the invention comprise a RNS-derepressible regulatory region from norB that is operatively linked to a gene or genes, e.g., a payload gene or genes. In the presence of RNS, an NsrR transcription factor senses RNS and no longer binds to the norB regulatory region, thereby derepressing the operatively linked a payload gene or genes and producing the encoding a payload(s).

In some embodiments, it is advantageous for the genetically engineered bacteria to express a RNS-sensing transcription factor that does not regulate the expression of a significant number of native genes in the bacteria. In some embodiments, the genetically engineered bacterium of the invention expresses a RNS-sensing transcription factor from a different species, strain, or substrain of bacteria, wherein the transcription factor does not bind to regulatory sequences in the genetically engineered bacterium of the invention. In some embodiments, the genetically engineered bacterium of the invention is *Escherichia coli*, and the RNS-sensing transcription factor is NsrR, e.g., from is *Neisseria gonorrhoeae*, wherein the *Escherichia coli* does not comprise binding sites for said NsrR. In some embodiments, the heterologous transcription factor minimizes or eliminates off-target effects on endogenous regulatory regions and genes in the genetically engineered bacteria.

In some embodiments, the tunable regulatory region is a RNS-repressible regulatory region, and binding of a corresponding transcription factor represses downstream gene expression; in the presence of RNS, the transcription factor senses RNS and binds to the RNS-repressible regulatory region, thereby repressing expression of the operatively linked gene or gene cassette. In some embodiments, the RNS-sensing transcription factor is capable of binding to a regulatory region that overlaps with part of the promoter sequence. In alternate embodiments, the RNS-sensing transcription factor is capable of binding to a regulatory region that is upstream or downstream of the promoter sequence.

In these embodiments, the genetically engineered bacteria may comprise a two repressor activation regulatory circuit, which is used to express a payload. The two repressor activation regulatory circuit comprises a first RNS-sensing repressor and a second repressor, which is operatively linked to a gene or gene cassette, e.g., encoding a payload. In one aspect of these embodiments, the RNS-sensing repressor inhibits transcription of the second repressor, which inhibits the transcription of the gene or gene cassette. Examples of second repressors useful in these embodiments, include, but are not limited to, TetR, C1, and LexA. In the absence of binding by the first repressor (which occurs in the absence of RNS), the second repressor is transcribed, which represses expression of the gene or genes. In the presence of binding by the first repressor (which occurs in the presence of RNS), expression of the second repressor is repressed, and the gene or genes, e.g., a payload gene or genes is expressed.

A RNS-responsive transcription factor may induce, derepress, or repress gene expression depending upon the regulatory region sequence used in the genetically engineered bacteria. One or more types of RNS-sensing transcription factors and corresponding regulatory region sequences may be present in genetically engineered bacteria. In some embodiments, the genetically engineered bacteria comprise one type of RNS-sensing transcription factor, e.g., NsrR, and one corresponding regulatory region sequence, e.g., from norB. In some embodiments, the genetically engineered bacteria comprise one type of RNS-sensing transcription factor, e.g., NsrR, and two or more different corresponding regulatory region sequences, e.g., from norB and aniA. In some embodiments, the genetically engineered bacteria comprise two or more types of RNS-sensing transcription factors, e.g., NsrR and NorR, and two or more corresponding regulatory region sequences, e.g., from norB and norR, respectively. One RNS-responsive regulatory region may be capable of binding more than one transcription factor. In some embodiments, the genetically engineered bacteria comprise two or more types of RNS-sensing transcription factors and one corresponding regulatory region sequence. Nucleic acid sequences of several RNS-regulated regulatory regions are known in the art (see, e.g., Spiro 2006; Isabella et al., 2009; Dunn et al., 2010; Vine et al., 2011; Karlinsey et al., 2012).

In some embodiments, the genetically engineered bacteria of the invention comprise a gene encoding a RNS-sensing transcription factor, e.g., the nsrR gene, that is controlled by its native promoter, an inducible promoter, a promoter that is stronger than the native promoter, e.g., the GlnRS promoter or the P(Bla) promoter, or a constitutive promoter. In some instances, it may be advantageous to express the RNS-sensing transcription factor under the control of an inducible promoter in order to enhance expression stability. In some embodiments, expression of the RNS-sensing transcription factor is controlled by a different promoter than the promoter that controls expression of the therapeutic molecule. In some embodiments, expression of the RNS-sensing transcription factor is controlled by the same promoter that controls expression of the therapeutic molecule. In some embodiments, the RNS-sensing transcription factor and therapeutic molecule are divergently transcribed from a promoter region.

In some embodiments, the genetically engineered bacteria of the invention comprise a gene for a RNS-sensing transcription factor from a different species, strain, or substrain of bacteria. In some embodiments, the genetically engineered bacteria comprise a RNS-responsive regulatory region from a different species, strain, or substrain of bacteria. In some embodiments, the genetically engineered bacteria comprise a RNS-sensing transcription factor and corresponding RNS-responsive regulatory region from a different species, strain, or substrain of bacteria. The heterologous RNS-sensing transcription factor and regulatory region may increase the transcription of genes operatively linked to said regulatory region in the presence of RNS, as compared to the native transcription factor and regulatory region from bacteria of the same subtype under the same conditions.

In some embodiments, the genetically engineered bacteria comprise a RNS-sensing transcription factor, NsrR, and corresponding regulatory region, nsrR, from *Neisseria gonorrhoeae*. In some embodiments, the native RNS-sensing transcription factor, e.g., NsrR, is left intact and retains wild-type activity. In alternate embodiments, the native RNS-sensing transcription factor, e.g., NsrR, is deleted or mutated to reduce or eliminate wild-type activity.

In some embodiments, the genetically engineered bacteria of the invention comprise multiple copies of the endogenous gene encoding the RNS-sensing transcription factor, e.g., the nsrR gene. In some embodiments, the gene encoding the RNS-sensing transcription factor is present on a plasmid. In some embodiments, the gene encoding the RNS-sensing transcription factor and the gene or gene cassette for producing the therapeutic molecule are present on different plasmids. In some embodiments, the gene encoding the RNS-sensing transcription factor and the gene or gene cassette for producing the therapeutic molecule are present on the same plasmid. In some embodiments, the gene encoding the RNS-sensing transcription factor is present on a chromosome. In some embodiments, the gene encoding the RNS-sensing transcription factor and the gene or gene cassette for producing the therapeutic molecule are present on different chromosomes. In some embodiments, the gene encoding the RNS-sensing transcription factor and the gene or gene cassette for producing the therapeutic molecule are present on the same chromosome.

In some embodiments, the genetically engineered bacteria comprise a wild-type gene encoding a RNS-sensing transcription factor, e.g., the NsrR gene, and a corresponding regulatory region, e.g., a norB regulatory region, that is mutated relative to the wild-type regulatory region from bacteria of the same subtype. The mutated regulatory region increases the expression of the payload in the presence of RNS, as compared to the wild-type regulatory region under the same conditions. In some embodiments, the genetically engineered bacteria comprise a wild-type RNS-responsive regulatory region, e.g., the norB regulatory region, and a corresponding transcription factor, e.g., NsrR, that is mutated relative to the wild-type transcription factor from bacteria of the same subtype. The mutant transcription factor increases the expression of the payload in the presence of RNS, as compared to the wild-type transcription factor under the same conditions. In some embodiments, both the RNS-sensing transcription factor and corresponding regulatory region are mutated relative to the wild-type sequences from bacteria of the same subtype in order to increase expression of the payload in the presence of RNS.

In some embodiments, the gene or gene cassette for producing the anti-cancer molecule is present on a plasmid and operably linked to a promoter that is induced by RNS. In some embodiments, expression is further optimized by methods known in the art, e.g., by optimizing ribosomal binding sites, manipulating transcriptional regulators, and/or increasing mRNA stability.

In some embodiments, any of the gene(s) of the present disclosure may be integrated into the bacterial chromosome at one or more integration sites. For example, one or more copies of one or more encoding a payload gene(s) may be integrated into the bacterial chromosome. Having multiple copies of the gene or gen(s) integrated into the chromosome allows for greater production of the payload(s) and also permits fine-tuning of the level of expression. Alternatively, different circuits described herein, such as any of the secretion or exporter circuits, in addition to the therapeutic gene(s) or gene cassette(s) could be integrated into the bacterial chromosome at one or more different integration sites to perform multiple different functions.

In some embodiments, the genetically engineered bacteria of the invention produce at least one payload in the presence of RNS to reduce local gut inflammation by at least about 1.5-fold, at least about 2-fold, at least about 10-fold, at least about 15-fold, at least about 20-fold, at least about 30-fold, at least about 50-fold, at least about 100-fold, at least about 200-fold, at least about 300-fold, at least about 400-fold, at least about 500-fold, at least about 600-fold, at least about 700-fold, at least about 800-fold, at least about 900-fold, at least about 1,000-fold, or at least about 1,500-fold as compared to unmodified bacteria of the same subtype under the same conditions. Inflammation may be measured by methods known in the art, e.g., counting disease lesions using endoscopy; detecting T regulatory cell differentiation in peripheral blood, e.g., by fluorescence activated sorting; measuring T regulatory cell levels; measuring cytokine levels; measuring areas of mucosal damage; assaying inflammatory biomarkers, e.g., by qPCR; PCR arrays; transcription factor phosphorylation assays; immunoassays; and/or cytokine assay kits (Mesoscale, Cayman Chemical, Qiagen).

In some embodiments, the genetically engineered bacteria produce at least about 1.5-fold, at least about 2-fold, at least about 10-fold, at least about 15-fold, at least about 20-fold, at least about 30-fold, at least about 50-fold, at least about 100-fold, at least about 200-fold, at least about 300-fold, at least about 400-fold, at least about 500-fold, at least about 600-fold, at least about 700-fold, at least about 800-fold, at least about 900-fold, at least about 1,000-fold, or at least about 1,500-fold more of payload in the presence of RNS than unmodified bacteria of the same subtype under the same conditions. Certain unmodified bacteria will not have detectable levels of the payload. In embodiments using genetically modified forms of these bacteria, payload will be detectable in the presence of RNS.

ROS-Dependent Regulation

In some embodiments, the genetically engineered bacteria or genetically engineered virus comprise a gene for producing a payload that is expressed under the control of an inducible promoter. In some embodiments, the genetically engineered bacterium or genetically engineered virus that expresses a payload under the control of a promoter that is activated by conditions of cellular damage. In one embodiment, the gene for producing the payload is expressed under the control of an cellular damaged-dependent promoter that is activated in environments in which there is cellular or tissue damage, e.g., a reactive oxygen species or ROS promoter.

As used herein, "reactive oxygen species" and "ROS" are used interchangeably to refer to highly active molecules, ions, and/or radicals derived from molecular oxygen. ROS can be produced as byproducts of aerobic respiration or metal-catalyzed oxidation and may cause deleterious cellular effects such as oxidative damage. ROS includes, but is not limited to, hydrogen peroxide ($H_2O_2$), organic peroxide (ROOH), hydroxyl ion (OH—), hydroxyl radical (·OH), superoxide or superoxide anion (·O2-), singlet oxygen (1O2), ozone (O3), carbonate radical, peroxide or peroxyl radical (·O2-2), hypochlorous acid (HOCl), hypochlorite ion (OCl—), sodium hypochlorite (NaOCl), nitric oxide (NO.), and peroxynitrite or peroxynitrite anion (ONOO—) (unpaired electrons denoted by ·). Bacteria have evolved transcription factors that are capable of sensing ROS levels. Different ROS signaling pathways are triggered by different ROS levels and occur with different kinetics (Marinho et al., 2014).

As used herein, "ROS-inducible regulatory region" refers to a nucleic acid sequence to which one or more ROS-sensing transcription factors is capable of binding, wherein the binding and/or activation of the corresponding transcription factor activates downstream gene expression; in the presence of ROS, the transcription factor binds to and/or activates the regulatory region. In some embodiments, the ROS-inducible regulatory region comprises a promoter sequence. In some embodiments, the transcription factor senses ROS and subsequently binds to the ROS-inducible regulatory region, thereby activating downstream gene expression. In alternate embodiments, the transcription factor is bound to the ROS-inducible regulatory region in the absence of ROS; in the presence of ROS, the transcription factor undergoes a conformational change, thereby activating downstream gene expression. The ROS-inducible regulatory region may be operatively linked to a gene sequence or gene sequence, e.g., a sequence or sequences encoding one or more payload(s). For example, in the presence of ROS, a transcription factor, e.g., OxyR, senses ROS and activates a corresponding ROS-inducible regulatory region, thereby driving expression of an operatively linked gene sequence or gene sequences. Thus, ROS induces expression of the gene or genes.

As used herein, "ROS-derepressible regulatory region" refers to a nucleic acid sequence to which one or more ROS-sensing transcription factors is capable of binding, wherein the binding of the corresponding transcription factor represses downstream gene expression; in the presence of ROS, the transcription factor does not bind to and does not repress the regulatory region. In some embodiments, the ROS-derepressible regulatory region comprises a promoter sequence. The ROS-derepressible regulatory region may be operatively linked to a gene or genes, e.g., one or more genes encoding one or more payload(s). For example, in the presence of ROS, a transcription factor, e.g., OhrR, senses ROS and no longer binds to and/or represses the regulatory region, thereby derepressing an operatively linked gene sequence or gene cassette. Thus, ROS depresses expression of the gene or gene cassette.

As used herein, "ROS-repressible regulatory region" refers to a nucleic acid sequence to which one or more ROS-sensing transcription factors is capable of binding, wherein the binding of the corresponding transcription factor represses downstream gene expression; in the presence of ROS, the transcription factor binds to and represses the regulatory region. In some embodiments, the ROS-repressible regulatory region comprises a promoter sequence. In some embodiments, the transcription factor that senses ROS is capable of binding to a regulatory region that overlaps with part of the promoter sequence. In alternate embodiments, the transcription factor that senses ROS is capable of binding to a regulatory region that is upstream or downstream of the promoter sequence. The ROS-repressible regulatory region may be operatively linked to a gene sequence or gene sequences. For example, in the presence of ROS, a transcription factor, e.g., PerR, senses ROS and binds to a corresponding ROS-repressible regulatory region, thereby blocking expression of an operatively linked gene sequence or gene sequences. Thus, ROS represses expression of the gene or genes.

As used herein, a "ROS-responsive regulatory region" refers to a ROS-inducible regulatory region, a ROS-repressible regulatory region, and/or a ROS-derepressible regulatory region. In some embodiments, the ROS-responsive regulatory region comprises a promoter sequence. Each regulatory region is capable of binding at least one corresponding ROS-sensing transcription factor. Examples of transcription factors that sense ROS and their corresponding ROS-responsive genes, promoters, and/or regulatory regions include, but are not limited to, those shown in Table 40.

TABLE 40

Examples of ROS-sensing transcription factors and ROS-responsive genes

| ROS-sensing transcription factor: | Primarily capable of sensing: | Examples of responsive genes, promoters, and/or regulatory regions: |
|---|---|---|
| OxyR | $H_2O_2$ | ahpC; ahpF; dps; dsbG; fhuF; flu; fur; gor; grxA; hemH; katG; oxyS; sufA; sufB; sufC; sufD; sufE; sufS; trxC; uxuA; yaaA; yaeH; yaiA; ybjM; ydcH; ydeN; ygaQ; yljA; ytfK |
| PerR | $H_2O_2$ | katA; ahpCF; mrgA; zoaA; fur; hemAXCDBL; srfA |
| OhrR | Organic peroxides NaOCl | ohrA |
| SoxR | ·$O_2^-$ NO• (also capable of sensing $H_2O_2$) | soxS |
| RosR | $H_2O_2$ | rbtT; tnp16a; rluC1; tnp5a; mscL; tnp2d; phoD; tnp15b; pstA; tnp5b; xylC; gabD1; rluC2; cgtS9; azlC; narKGHJI; rosR |

In some embodiments, the genetically engineered bacteria comprise a tunable regulatory region that is directly or indirectly controlled by a transcription factor that is capable of sensing at least one reactive oxygen species. The tunable regulatory region is operatively linked to a gene or gene cassette capable of directly or indirectly driving the expression of a payload, thus controlling expression of the payload relative to ROS levels. For example, the tunable regulatory region is a ROS-inducible regulatory region, and the molecule is a payload; when ROS is present, e.g., in an inflamed tissue, a ROS-sensing transcription factor binds to and/or activates the regulatory region and drives expression of the gene sequence for the payload, thereby producing the payload. Subsequently, when inflammation is ameliorated, ROS levels are reduced, and production of the payload is decreased or eliminated.

In some embodiments, the tunable regulatory region is a ROS-inducible regulatory region; in the presence of ROS, a transcription factor senses ROS and activates the ROS-inducible regulatory region, thereby driving expression of an operatively linked gene or gene cassette. In some embodiments, the transcription factor senses ROS and subsequently binds to the ROS-inducible regulatory region, thereby activating downstream gene expression. In alternate embodiments, the transcription factor is bound to the ROS-inducible regulatory region in the absence of ROS; when the transcription factor senses ROS, it undergoes a conformational change, thereby inducing downstream gene expression.

In some embodiments, the tunable regulatory region is a ROS-inducible regulatory region, and the transcription factor that senses ROS is OxyR. OxyR "functions primarily as a global regulator of the peroxide stress response" and is capable of regulating dozens of genes, e.g., "genes involved in H2O2 detoxification (katE, ahpCF), heme biosynthesis (hemH), reductant supply (grxA, gor, trxC), thiol-disulfide isomerization (dsbG), Fe—S center repair (sufA-E, sufS), iron binding (yaaA), repression of iron import systems (fur)" and "OxyS, a small regulatory RNA" (Dubbs et al., 2012). The genetically engineered bacteria may comprise any suitable ROS-responsive regulatory region from a gene that is activated by OxyR. Genes that are capable of being activated by OxyR are known in the art (see, e.g., Zheng et al., 2001; Dubbs et al., 2012). In certain embodiments, the genetically engineered bacteria of the invention comprise a ROS-inducible regulatory region from oxyS that is operatively linked to a gene, e.g., a payload gene. In the presence of ROS, e.g., H2O2, an OxyR transcription factor senses ROS and activates to the oxyS regulatory region, thereby driving expression of the operatively linked payload gene and producing the payload. In some embodiments, OxyR is encoded by an E. coli oxyR gene. In some embodiments, the oxyS regulatory region is an E. coli oxyS regulatory region. In some embodiments, the ROS-inducible regulatory region is selected from the regulatory region of katG, dps, and ahpC.

In alternate embodiments, the tunable regulatory region is a ROS-inducible regulatory region, and the corresponding transcription factor that senses ROS is SoxR. When SoxR is "activated by oxidation of its [2Fe-2S] cluster, it increases the synthesis of SoxS, which then activates its target gene expression" (Koo et al., 2003). "SoxR is known to respond primarily to superoxide and nitric oxide" (Koo et al., 2003), and is also capable of responding to H2O2. The genetically engineered bacteria of the invention may comprise any suitable ROS-responsive regulatory region from a gene that is activated by SoxR. Genes that are capable of being activated by SoxR are known in the art (see, e.g., Koo et al., 2003). In certain embodiments, the genetically engineered bacteria of the invention comprise a ROS-inducible regulatory region from soxS that is operatively linked to a gene, e.g., a payload. In the presence of ROS, the SoxR transcription factor senses ROS and activates the soxS regulatory region, thereby driving expression of the operatively linked a payload gene and producing the a payload.

In some embodiments, the tunable regulatory region is a ROS-derepressible regulatory region, and binding of a corresponding transcription factor represses downstream gene expression; in the presence of ROS, the transcription factor no longer binds to the regulatory region, thereby derepressing the operatively linked gene or gene cassette.

In some embodiments, the tunable regulatory region is a ROS-derepressible regulatory region, and the transcription factor that senses ROS is OhrR. OhrR "binds to a pair of inverted repeat DNA sequences overlapping the ohrA promoter site and thereby represses the transcription event," but oxidized OhrR is "unable to bind its DNA target" (Duarte et al., 2010). OhrR is a "transcriptional repressor [that] . . . senses both organic peroxides and NaOCl" (Dubbs et al., 2012) and is "weakly activated by H2O2 but it shows much higher reactivity for organic hydroperoxides" (Duarte et al., 2010). The genetically engineered bacteria of the invention may comprise any suitable ROS-responsive regulatory region from a gene that is repressed by OhrR. Genes that are capable of being repressed by OhrR are known in the art (see, e.g., Dubbs et al., 2012). In certain embodiments, the genetically engineered bacteria of the invention comprise a ROS-depressible regulatory region from ohrA that is operatively linked to a gene or gene cassette, e.g., a payload gene. In the presence of ROS, e.g., NaOCl, an OhrR transcription factor senses ROS and no longer binds to the ohrA regulatory region, thereby derepressing the operatively linked payload gene and producing the a payload.

OhrR is a member of the MarR family of ROS-responsive regulators. "Most members of the MarR family are transcriptional repressors and often bind to the -10 or -35 region in the promoter causing a steric inhibition of RNA polymerase binding" (Bussmann et al., 2010). Other members of this family are known in the art and include, but are not limited to, OspR, MgrA, RosR, and SarZ. In some embodiments, the transcription factor that senses ROS is OspR, MgRA, RosR, and/or SarZ, and the genetically engineered bacteria of the invention comprises one or more corresponding regulatory region sequences from a gene that is repressed by OspR, MgRA, RosR, and/or SarZ. Genes that are capable of being repressed by OspR, MgRA, RosR, and/or SarZ are known in the art (see, e.g., Dubbs et al., 2012).

In some embodiments, the tunable regulatory region is a ROS-derepressible regulatory region, and the corresponding transcription factor that senses ROS is RosR. RosR is "a MarR-type transcriptional regulator" that binds to an "18-bp inverted repeat with the consensus sequence TTGTTGAY-RYRTCAACWA" and is "reversibly inhibited by the oxidant H2O2" (Bussmann et al., 2010). RosR is capable of repressing numerous genes and putative genes, including but not limited to "a putative polyisoprenoid-binding protein (cg1322, gene upstream of and divergent from rosR), a sensory histidine kinase (cgtS9), a putative transcriptional regulator of the Crp/FNR family (cg3291), a protein of the glutathione S-transferase family (cg1426), two putative FMN reductases (cg1150 and cg1850), and four putative monooxygenases (cg0823, cg1848, cg2329, and cg3084)" (Bussmann et al., 2010). The genetically engineered bacteria of the invention may comprise any suitable ROS-responsive regulatory region from a gene that is repressed by RosR. Genes that are capable of being repressed by RosR are known in the art (see, e.g., Bussmann et al., 2010). In certain embodiments, the genetically engineered bacteria of the invention comprise a ROS-derepressible regulatory region from cgtS9 that is operatively linked to a gene or gene cassette, e.g., a payload. In the presence of ROS, e.g., H2O2, a RosR transcription factor senses ROS and no longer binds to the cgtS9 regulatory region, thereby derepressing the operatively linked payload gene and producing the payload.

In some embodiments, it is advantageous for the genetically engineered bacteria to express a ROS-sensing transcription factor that does not regulate the expression of a significant number of native genes in the bacteria. In some embodiments, the genetically engineered bacterium of the invention expresses a ROS-sensing transcription factor from a different species, strain, or substrain of bacteria, wherein the transcription factor does not bind to regulatory sequences in the genetically engineered bacterium of the invention. In some embodiments, the genetically engineered bacterium of the invention is *Escherichia coli*, and the ROS-sensing transcription factor is RosR, e.g., from *Corynebacterium glutamicum*, wherein the *Escherichia coli* does not comprise binding sites for said RosR. In some embodiments, the heterologous transcription factor minimizes or eliminates off-target effects on endogenous regulatory regions and genes in the genetically engineered bacteria.

In some embodiments, the tunable regulatory region is a ROS-repressible regulatory region, and binding of a corresponding transcription factor represses downstream gene expression; in the presence of ROS, the transcription factor senses ROS and binds to the ROS-repressible regulatory region, thereby repressing expression of the operatively linked gene or gene cassette. In some embodiments, the ROS-sensing transcription factor is capable of binding to a regulatory region that overlaps with part of the promoter sequence. In alternate embodiments, the ROS-sensing transcription factor is capable of binding to a regulatory region that is upstream or downstream of the promoter sequence.

In some embodiments, the tunable regulatory region is a ROS-repressible regulatory region, and the transcription factor that senses ROS is PerR. In *Bacillus subtilis*, PerR "when bound to DNA, represses the genes coding for proteins involved in the oxidative stress response (katA, ahpC, and mrgA), metal homeostasis (hemAXCDBL, fur, and zoaA) and its own synthesis (perR)" (Marinho et al., 2014). PerR is a "global regulator that responds primarily to H2O2" (Dubbs et al., 2012) and "interacts with DNA at the per box, a specific palindromic consensus sequence (TTATAATNATTATAA) residing within and near the promoter sequences of PerR-controlled genes" (Marinho et al., 2014). PerR is capable of binding a regulatory region that "overlaps part of the promoter or is immediately downstream from it" (Dubbs et al., 2012). The genetically engineered bacteria of the invention may comprise any suitable ROS-responsive regulatory region from a gene that is repressed by PerR. Genes that are capable of being repressed by PerR are known in the art (see, e.g., Dubbs et al., 2012).

In these embodiments, the genetically engineered bacteria may comprise a two repressor activation regulatory circuit, which is used to express a payload. The two repressor activation regulatory circuit comprises a first ROS-sensing repressor, e.g., PerR, and a second repressor, e.g., TetR, which is operatively linked to a gene or gene cassette, e.g., a payload. In one aspect of these embodiments, the ROS-sensing repressor inhibits transcription of the second repressor, which inhibits the transcription of the gene or gene cassette. Examples of second repressors useful in these embodiments include, but are not limited to, TetR, C1, and LexA. In some embodiments, the ROS-sensing repressor is PerR. In some embodiments, the second repressor is TetR. In this embodiment, a PerR-repressible regulatory region drives expression of TetR, and a TetR-repressible regulatory region drives expression of the gene or gene cassette, e.g., a payload. In the absence of PerR binding (which occurs in the absence of ROS), tetR is transcribed, and TetR represses expression of the gene or gene cassette, e.g., a payload. In the presence of PerR binding (which occurs in the presence of ROS), tetR expression is repressed, and the gene or gene cassette, e.g., a payload, is expressed.

A ROS-responsive transcription factor may induce, derepress, or repress gene expression depending upon the regulatory region sequence used in the genetically engineered bacteria. For example, although "OxyR is primarily thought of as a transcriptional activator under oxidizing conditions . . . OxyR can function as either a repressor or activator under both oxidizing and reducing conditions" (Dubbs et al., 2012), and OxyR "has been shown to be a repressor of its own expression as well as that of fhuF (encoding a ferric ion reductase) and flu (encoding the antigen 43 outer membrane protein)" (Zheng et al., 2001). The genetically engineered bacteria of the invention may comprise any suitable ROS-responsive regulatory region from a gene that is repressed by OxyR. In some embodiments, OxyR is used in a two repressor activation regulatory circuit, as described above. Genes that are capable of being repressed by OxyR are known in the art (see, e.g., Zheng et al., 2001). Or, for example, although RosR is capable of repressing a number of genes, it is also capable of activating certain genes, e.g., the narKGHJI operon. In some embodiments, the genetically engineered bacteria comprise any suitable ROS-responsive regulatory region from a gene that is activated by RosR. In addition, "PerR-mediated positive regulation has also been observed . . . and appears to involve PerR binding to distant upstream sites" (Dubbs et al., 2012). In some embodiments, the genetically engineered bacteria comprise any suitable ROS-responsive regulatory region from a gene that is activated by PerR.

One or more types of ROS-sensing transcription factors and corresponding regulatory region sequences may be present in genetically engineered bacteria. For example, "OhrR is found in both Gram-positive and Gram-negative bacteria and can coreside with either OxyR or PerR or both" (Dubbs et al., 2012). In some embodiments, the genetically engineered bacteria comprise one type of ROS-sensing transcription factor, e.g., OxyR, and one corresponding regulatory region sequence, e.g., from oxyS. In some embodiments, the genetically engineered bacteria comprise one type of ROS-sensing transcription factor, e.g., OxyR, and two or more different corresponding regulatory region sequences, e.g., from oxyS and katG. In some embodiments, the genetically engineered bacteria comprise two or more types of ROS-sensing transcription factors, e.g., OxyR and PerR, and two or more corresponding regulatory region sequences, e.g., from oxyS and katA, respectively. One ROS-responsive regulatory region may be capable of binding more than one transcription factor. In some embodiments, the genetically engineered bacteria comprise two or more types of ROS-sensing transcription factors and one corresponding regulatory region sequence.

Nucleic acid sequences of several exemplary OxyR-regulated regulatory regions are shown in Table 41. OxyR binding sites are underlined and bolded. In some embodiments, genetically engineered bacteria comprise a nucleic acid sequence that is at least about 80%, at least about 85%, at least about 90%, at least about 95%, or at least about 99% homologous to the DNA sequence of SEQ ID NO: 580, SEQ ID NO: 581, SEQ ID NO: 582, or SEQ ID NO: 583, or a functional fragment thereof.

TABLE 41

Nucleotide sequences of exemplary OxyR-regulated regulatory regions

| Regulatory sequence | Sequence |
|---|---|
| katG (SEQ ID NO: 580) | TGTGGCTTTTATGAAAATCACACAGTGATCACAAATTTTAAACA GAGCACAAAATGCTGCCTCGAAATGAGGGCGGGAAAATAAGGT TATCAGCCTTGTTTTCTCCCTCATTACTTGAAGGATATGAAGCTA AAACCCTTTTTTATAAAGCATTTGTCCGAATTCGGACATAATCA AAAAAGCTTAATTAAGATCAATTTGATCTACATCTCTTTAACCA ACAATAT<u>GTAAGATCTCAACTATCGCATCCGTGGATTAATTCAA TTA</u>TAACTTCTCTCTAACGCTGTGTATCGTAACGGTAACACTGTA GAGGGGAGCACATTGATGCGAATTCATTAAAGAGGAGAAAGGT ACC |
| dps (SEQ ID NO: 581) | TTCCGAAAATTCCTGGCGAGCAGATAAATAAGAATTGTTCTTAT CAATATATCTAACTCATTGAATCTTTATTAGTTTTGTTTTTCA<u>CG CTTGTTACCACTATTAGTGTGATAGGAACAGCCAGAAT</u>AGCGGA ACACATAGCCGGTGCTATACTTAATCTCGTTAATTACTGGGACA TAACATCAAGAGGATATGAAATTCGAATTCATTAAAGAGGAGA AAGGTACC |
| ahpC (SEQ ID NO: 582) | GCTTAGATCAGGTGATTGCCCTTTGTTTATGAGGGTGTTGTAATC CATGTCGTTGTTGCATTTGTAAGGGCAACACCTCAGCCTGCAGG CAGGCACTGAAGATACCAAAGGGTAGTTCAGATTACACGGTCA CCTGGAAAGGGGGCCATTTTACTTTTTATCGCCGCTGGCGGTGC AAAGTTCACAAAGTTGTCTTACGAAGGTT<u>GTAAGGTAAAACTTA TCGATTTGATAATGGAAACGCATT</u>AGCCGAATCGGCAAAAATTG GTTACCTTACATCTCATCGAAAACACGGAGGAAGTATAGATGCG AATTCATTAAAGAGGAGAAAGGTACC |
| oxyS (SEQ ID NO: 583) | CTCGAGTTCATTATCCATCCTCCATCGCCAC<u>GATAGTTCATGGCG ATAGGTAGAATAGCAATGAACGATTA</u>TCCCTATCAAGCATTCTG ACTGATAATTGCTCACACGAATTCATTAAAGAGGAGAAAGGTA CC |

In some embodiments, the regulatory region sequence is at least about 80%, at least about 85%, at least about 90%, at least about 95%, or at least about 99% homologous to the sequence of SEQ ID NO: 580, SEQ ID NO: 581, SEQ ID NO: 582, and/or SEQ ID NO: 583.

In some embodiments, the genetically engineered bacteria of the invention comprise a gene encoding a ROS-sensing transcription factor, e.g., the oxyR gene, that is controlled by its native promoter, an inducible promoter, a promoter that is stronger than the native promoter, e.g., the GlnRS promoter or the P(Bla) promoter, or a constitutive promoter. In some instances, it may be advantageous to express the ROS-sensing transcription factor under the control of an inducible promoter in order to enhance expression stability. In some embodiments, expression of the ROS-sensing transcription factor is controlled by a different promoter than the promoter that controls expression of the therapeutic molecule. In some embodiments, expression of the ROS-sensing transcription factor is controlled by the same promoter that controls expression of the therapeutic molecule. In some embodiments, the ROS-sensing transcription factor and therapeutic molecule are divergently transcribed from a promoter region.

In some embodiments, the genetically engineered bacteria of the invention comprise a gene for a ROS-sensing transcription factor from a different species, strain, or substrain of bacteria. In some embodiments, the genetically engineered bacteria comprise a ROS-responsive regulatory region from a different species, strain, or substrain of bacteria. In some embodiments, the genetically engineered bacteria comprise a ROS-sensing transcription factor and corresponding ROS-responsive regulatory region from a different species, strain, or substrain of bacteria. The heterologous ROS-sensing transcription factor and regulatory region may increase the transcription of genes operatively linked to said regulatory region in the presence of ROS, as compared to the native transcription factor and regulatory region from bacteria of the same subtype under the same conditions.

In some embodiments, the genetically engineered bacteria comprise a ROS-sensing transcription factor, OxyR, and corresponding regulatory region, oxyS, from Escherichia coli. In some embodiments, the native ROS-sensing transcription factor, e.g., OxyR, is left intact and retains wild-type activity. In alternate embodiments, the native ROS-sensing transcription factor, e.g., OxyR, is deleted or mutated to reduce or eliminate wild-type activity.

In some embodiments, the genetically engineered bacteria of the invention comprise multiple copies of the endogenous gene encoding the ROS-sensing transcription factor, e.g., the oxyR gene. In some embodiments, the gene encoding the ROS-sensing transcription factor is present on a plasmid. In some embodiments, the gene encoding the ROS-sensing transcription factor and the gene or gene cassette for producing the therapeutic molecule are present on different plasmids. In some embodiments, the gene encoding the ROS-sensing transcription factor and the gene or gene cassette for producing the therapeutic molecule are present on the same. In some embodiments, the gene encoding the ROS-sensing transcription factor is present on a chromosome. In some embodiments, the gene encoding the ROS-sensing transcription factor and the gene or gene cassette for producing the therapeutic molecule are present on different chromosomes. In some embodiments, the gene encoding the ROS-sensing transcription factor and the gene or gene cassette for producing the therapeutic molecule are present on the same chromosome.

In some embodiments, the genetically engineered bacteria comprise a wild-type gene encoding a ROS-sensing transcription factor, e.g., the soxR gene, and a corresponding regulatory region, e.g., a soxS regulatory region, that is mutated relative to the wild-type regulatory region from bacteria of the same subtype. The mutated regulatory region increases the expression of the payload in the presence of ROS, as compared to the wild-type regulatory region under the same conditions. In some embodiments, the genetically engineered bacteria comprise a wild-type ROS-responsive regulatory region, e.g., the oxyS regulatory region, and a corresponding transcription factor, e.g., OxyR, that is mutated relative to the wild-type transcription factor from bacteria of the same subtype. The mutant transcription factor increases the expression of the payload in the presence of ROS, as compared to the wild-type transcription factor under the same conditions. In some embodiments, both the ROS-sensing transcription factor and corresponding regulatory region are mutated relative to the wild-type sequences from bacteria of the same subtype in order to increase expression of the payload in the presence of ROS.

In some embodiments, the gene or gene cassette for producing the payload is present on a plasmid and operably linked to a promoter that is induced by ROS. In some embodiments, the gene or gene cassette for producing the payload is present in the chromosome and operably linked to a promoter that is induced by ROS. In some embodiments, the gene or gene cassette for producing the payload is present on a chromosome and operably linked to a promoter that is induced by exposure to tetracycline. In some embodiments, the gene or gene cassette for producing the payload is present on a plasmid and operably linked to a promoter that is induced by exposure to tetracycline. In some embodiments, expression is further optimized by methods known in the art, e.g., by optimizing ribosomal binding sites, manipulating transcriptional regulators, and/or increasing mRNA stability.

In some embodiments, the genetically engineered bacteria may comprise multiple copies of the gene(s) capable of producing a payload(s). In some embodiments, the gene(s) capable of producing a payload(s) is present on a plasmid and operatively linked to a ROS-responsive regulatory region. In some embodiments, the gene(s) capable of producing a payload is present in a chromosome and operatively linked to a ROS-responsive regulatory region.

Thus, in some embodiments, the genetically engineered bacteria or genetically engineered virus produce one or more payloads under the control of an oxygen level-dependent promoter, a reactive oxygen species (ROS)-dependent promoter, or a reactive nitrogen species (RNS)-dependent promoter, and a corresponding transcription factor.

In some embodiments, the genetically engineered bacteria comprise a stably maintained plasmid or chromosome carrying a gene for producing a payload, such that the payload can be expressed in the host cell, and the host cell is capable of survival and/or growth in vitro, e.g., in medium, and/or in vivo. In some embodiments, a bacterium may comprise multiple copies of the gene encoding the payload. In some embodiments, the gene encoding the payload is expressed on a low-copy plasmid. In some embodiments, the low-copy plasmid may be useful for increasing stability of expression. In some embodiments, the low-copy plasmid may be useful for decreasing leaky expression under non-inducing conditions. In some embodiments, the gene encoding the payload is expressed on a high-copy plasmid. In some embodiments, the high-copy plasmid may be useful for increasing expression of the payload. In some embodiments, the gene encoding the payload is expressed on a chromosome.

Propionate and Other Promoters

In some embodiments, the genetically engineered bacteria comprise the gene or gene cassette for producing anti-cancer molecule expressed under the control of an inducible promoter that is responsive to specific molecules or metabolites in the environment, e.g., the tumor microenvironment, a specific tissue, or the mammalian gut. For example, the short-chain fatty acid propionate is a major microbial fermentation metabolite localized to the gut (Hosseini et al., 2011). In one embodiment, the gene or gene cassette for producing anti-cancer molecule is under the control of a propionate-inducible promoter. In a more specific embodiment, the gene or gene cassette for producing the anti-cancer molecule is under the control of a propionate-inducible promoter that is activated by the presence of propionate in the mammalian gut. Any molecule or metabolite found in the mammalian gut, in a healthy and/or disease state, may be used to induce payload expression. Non-limiting examples of inducers include propionate, bilirubin, aspartate aminotransferase, alanine aminotransferase, blood coagulation factors II, VII, IX, and X, alkaline phosphatase, gamma glutamyl transferase, hepatitis antigens and antibodies, alpha fetoprotein, anti-mitochondrial, smooth muscle, and anti-nuclear antibodies, iron, transferrin, ferritin, copper, ceruloplasmin, ammonia, and manganese. In alternate embodiments, the gene or gene cassette for producing anti-cancer molecule is under the control of a pBAD promoter, which is activated in the presence of the sugar arabinose.

In some embodiments, the gene or gene cassette for producing the anti-cancer molecule is present on a plasmid and operably linked to a promoter that is induced under low-oxygen or anaerobic conditions. In some embodiments, the gene or gene cassette for producing anti-cancer molecule is present in the chromosome and operably linked to a promoter that is induced under low-oxygen or anaerobic conditions. In some embodiments, the gene or gene cassette for producing anti-cancer molecule is present on a plasmid and operably linked to a promoter that is induced by molecules or metabolites that are specific to the to the tumore and/or the mammalian gut. In some embodiments, the gene or gene cassette for producing anti-cancer molecule is present on a chromosome and operably linked to a promoter that is induced by molecules or metabolites that are specific to the tumor and/or the mammalian gut. In some embodiments, the gene or gene cassette for producing anti-cancer molecule is present on a chromosome and operably linked to a promoter that is induced by exposure to tetracycline. In some embodiments, the gene or gene cassette for producing anti-cancer molecule is present on a plasmid and operably linked to a promoter that is induced by exposure to tetracycline. In some embodiments, expression is further optimized by methods known in the art, e.g., by optimizing ribosomal binding sites, manipulating transcriptional regulators, and/or increasing mRNA stability.

In some embodiments, the genetically engineered bacteria comprise a stably maintained plasmid or chromosome carrying the gene or gene cassette for producing the anti-cancer molecule, such that the gene or gene cassette can be expressed in the host cell, and the host cell is capable of survival and/or growth in vitro, e.g., in medium, and/or in vivo, e.g., in the gut. In some embodiments, a bacterium may comprise multiple copies of the gene or gene cassette for producing anti-cancer molecule. In some embodiments, gene or gene cassette for producing the payload is expressed on a low-copy plasmid. In some embodiments, the low-copy plasmid may be useful for increasing stability of expression. In some embodiments, the low-copy plasmid may be useful for decreasing leaky expression under non-inducing conditions. In some embodiments, gene or gene cassette for producing anti-cancer molecule is expressed on a high-copy plasmid. In some embodiments, the high-copy plasmid may be useful for increasing gene or gene cassette expression. In some embodiments, gene or gene cassette for producing anti-cancer molecule is expressed on a chromosome.

Table 42 lists a propionate promoter sequence. In some embodiments, the propionate promoter is induced in the mammalian gut. In some embodiments, the propionate promoter sequence is at least about 80%, at least about 85%, at least about 90%, at least about 95%, or at least about 99% homologous to the sequence of SEQ ID NO: 584.

chemical inducer(s) and/or metabolite(s). In some embodiments, the gene encoding the anti-cancer molecule is present in the chromosome and operably linked to a promoter that is induced by one or more nutritional and/or chemical inducer (s) and/or metabolite(s).

In some embodiments, the bacterial cell comprises a stably maintained plasmid or chromosome carrying the one or more gene sequences(s), inducible by one or more nutritional and/or chemical inducer(s) and/or metabolite(s), encoding the anti-cancer molecule, such that the anti-cancer molecule can be expressed in the host cell, and the host cell is capable of survival and/or growth in vitro, e.g., in medium, and/or in vivo, e.g., in the tumor or in the gut. In some embodiments, bacterial cell comprises two or more distinct copies of the one or more gene sequences(s) encoding the anti-cancer molecule, which is controlled by a promoter inducible one or more nutritional and/or chemical

TABLE 42

Propionate promoter sequence

| Description | Sequence |
|---|---|
| Prp (Propionate) promoter Bold: prpR Lower case: ribosome binding site ATG underlined: start of gene of interest SEQ ID NO: 584 | TTACCCGTCTGGATTTTCAGTACGCGCTTTTAAACGACGCCA CAGCGTGGTACGGCTGATCCCCAAATAACGTGCGGCGGCGCG CTTATCGCCATTAAAGCGTGCGAGCACCTCCTGCAATGGAAG CGCTTCTGCTGACGAGGGCGTGATTTCTGCTGTGGTCCCCAC CAGTTCAGGTAATAATTGCCGCATAAATTGTCTGTCCAGTGT TGGTGCGGGATCGACGCTTAAAAAAAGCGCCAGGCGTTCCAT CATATTCCGCAGTTCGCGAATATTACCGGGCCAATGATAGTT CAGTAGAAGCGGCTGACACTGCGTCAGCCCATGACGCACCGA TTCGGTAAAAGGGATCTCCATCGCGGCCAGCGATTGTTTTAA AAAGTTTTCCGCCAGAGGCAGAATATCAGGCTGTCGCTCGCG CAAGGGGGAAGCGGCAGACGCAGAATGCTCAAACGGTAAAA CAGATCGGTACGAAAACGTCCTTGCGTTATCTCCCGATCCAG ATCGCAATGCGTGGCGCTGATCACCCGGACATCTACCGGAT CGGCTGATGCCCGCCAACGCGGGTGACGGCTTTTTCCTCCAG TACGCGTAGAAGGCGGGTTTGTAACGGCAGCGGCATTTCGCC AATTTCGTCAAGAAACAGCGTGCCGCCGTGGGCGACCTCAAA CAGCCCCGCACGTCCACCTCGTCTTGAGCCGGTAAACGCTCC CTCCTCATAGCCAAACAGTTCAGCCTCCAGCAACGACTCGGT AATCGCGCCGCAATTAACGGCGACAAAGGGCGGAGAAGGCTT GTTCTGACGGTGGGGCTGACGGTTAAACAACGCCTGATGAAT CGCTTGCGCCGCCAGCTCTTTCCCGGTCCCTGTTTCCCCCTG AATCAGCACTGCCGCGCGGGAACGGGCATAGAGTGTAATCGT ATGGCGAACCTGCTCCATTTGTGGTGAATCGCCGAGGATATC GCTCAGCGCATAACGGGTCTGTAATCCCTTGCTGGAGGTATG CTGGCTATACTGACGCCGTGTCAGGCGGGTCATATCCAGCGC ATCATGGAAAGCCTGACGTACGGTGGCCGCTGAATAAATAAA GATGGCGGTCATTCCTGCCTCTTCCGCCAGGTCGGTAATTAG TCCTGCCCCAATTACAGCCTCAATGCCGTTAGCTTTGAGCTC GTTAATTTGCCCGCGAGCATCCTCTTCAGTGATATAGCTTCG CTGTTCAAGACGGAGGTGAAACGTTTTCTGAAAGGCGACCAG AGCCGGAATGGTCTCCTGATAGGTCACGATTCCCATTGAGGA AGTCAGCTTTCCCGCTTTTGCCAGAGCCTGTAATACATCGAA TCCGCTGGGTTTGATGAGGATGACAGGTACCGACAGTCGGCT TTTTAAATAAGCGCCGTTGGAACCTGCCGCGATAATCGCGTC GCAGCGTTCGGTTGCCAGTTTTTTGCGAATGTAGGCTACTGC CTTTTCAAAACCGAGCTGAATAGGCGTGATCGTCGCCAGATG ATCAAACTCCAGGCTGATATCCCGAAATAGTTCGAACAGGCG CGTTACCGAGACCGTCCAGATCACCGGTTTATCGCTATTATC GCGCGAAGCGCTATGCACAGTAACCATCGTCGTAGATTCATG TTTAAGGAACGAATTCTTGTTTTATAGATGTTTCGTTAATGT TGCAATGAAACACAGGCCTCCGTTTCATGAAACGTTAGCTGA CTCGTTTTCTTGTGACTCGTCTGTCAGTATTAAAAAAGATT TTTCATTTAACTGATTGTTTTTAAATTGAATTTTATTTAATG GTTTCTCGGTTTTTGGGTCTGGCATATCCCTTGCTTTAATGA GTGCATCTTAATTAACAATTCAATAACAAGAGGGCTGAATag taatttcaacaaaataacgagcattcga<u>atg</u> |

Other Inducible Promoters

In some embodiments, the gene encoding the anti-cancer molecule is present on a plasmid and operably linked to a promoter that is induced by one or more nutritional and/or inducer(s) and/or metabolite(s). In some embodiments, the genetically engineered bacteria comprise multiple copies of the same one or more gene sequences(s) encoding the anti-cancer molecule, which is controlled by a promoter inducible one or more nutritional and/or chemical inducer(s)

and/or metabolite(s). In some embodiments, the one or more gene sequences(s) encoding the anti-cancer molecule(s), is present on a plasmid and operably linked to a directly or indirectly inducible promoter inducible by one or more nutritional and/or chemical inducer(s) and/or metabolite(s). In some embodiments, the one or more gene sequences(s) encoding the anti-cancer molecule, is present on a chromosome and operably linked to a directly or indirectly inducible by one or more nutritional and/or chemical inducer(s) and/or metabolite(s).

In some embodiments, one or more gene sequence(s) encoding polypeptides of interest described herein is present on a plasmid and operably linked to promoter a directly or indirectly inducible by one or more nutritional and/or chemical inducer(s) and/or metabolite(s). In some embodiments, the bacterial cell comprises a stably maintained plasmid or chromosome carrying the gene encoding the anti-cancer molecule, which is induced by one or more nutritional and/or chemical inducer(s) and/or metabolite(s), such that the anti-cancer molecule can be expressed in the host cell, and the host cell is capable of survival and/or growth in vitro, e.g., under culture conditions, and/or in vivo, e.g., in the gut and/or the tumor microenvironment. In some embodiments, bacterial cell comprises two or more gene sequence(s) for the production of a polypeptide of interest, one or more of which are induced by one or more nutritional and/or chemical inducer(s) and/or metabolite(s). In some embodiments, the genetically engineered bacteria comprise multiple copies of the same gene sequence(s) for the production of a polypeptide of interest which are induced by one or more nutritional and/or chemical inducer(s) and/or metabolite(s). In some embodiments, the genetically engineered bacteria comprise multiple copies of different gene sequence(s) for the production of a polypeptide of interest, one or more of which are induced by one or more nutritional and/or chemical inducer(s) and/or metabolite(s).

In some embodiments, the gene sequence(s) for the production of a polypeptide of interest is present on a plasmid and operably linked to a promoter that is induced by one or more nutritional and/or chemical inducer(s) and/or metabolite(s). In some embodiments, gene sequence(s) for the production of a polypeptide of interest is present in the chromosome and operably linked to a promoter that is induced by one or more nutritional and/or chemical inducer(s) and/or metabolite(s).

In some embodiments, the promoter that is operably linked to the gene encoding the polypeptide of interest is directly or indirectly induced by one or more nutritional and/or chemical inducer(s) and/or metabolite(s).

In some embodiments, one or more inducible promoter(s) are useful for or induced during in vivo expression of the one or more protein(s) of interest. In some embodiments, the promoters are induced during in vivo expression of one or more anti-cancer molecules and/or other polypeptide(s) of interest. In some embodiments, expression of one or more anti-cancer molecule(s) and/or other polypeptide(s) of interest is driven directly or indirectly by one or more arabinose inducible promoter(s) in vivo. In some embodiments, the promoter is directly or indirectly induced by a chemical and/or nutritional inducer and/or metabolite which is co-administered with the genetically engineered bacteria of the invention.

In some embodiments, expression of one or more anti-cancer molecule and/or other polypeptide(s) of interest, is driven directly or indirectly by one or more promoter(s) induced by a chemical and/or nutritional inducer and/or metabolite during in vitro growth, preparation, or manufacturing of the strain prior to in vivo administration. In some embodiments, the promoter(s) induced by a chemical and/or nutritional inducer and/or metabolite are induced in culture, e.g., grown in a flask, fermenter or other appropriate culture vessel, e.g., used during cell growth, cell expansion, fermentation, recovery, purification, formulation, and/or manufacture. In some embodiments, the promoter is directly or indirectly induced by a molecule that is added to in the bacterial culture to induce expression and pre-load the bacterium with anti-cancer molecule(s) and/or other polypeptide(s) of interest prior to administration. In some embodiments, the cultures, which are induced by a chemical and/or nutritional inducer and/or metabolite, are grown aerobically. In some embodiments, the cultures, which are induced by a chemical and/or nutritional inducer and/or metabolite, are grown anaerobically.

The genes of arabinose metabolism are organized in one operon, AraBAD, which is controlled by the PAraBAD promoter. The PAraBAD (or Para) promoter suitably fulfills the criteria of inducible expression systems. PAraBAD displays tighter control of payload gene expression than many other systems, likely due to the dual regulatory role of AraC, which functions both as an inducer and as a repressor. Additionally, the level of ParaBAD-based expression can be modulated over a wide range of L-arabinose concentrations to fine-tune levels of expression of the payload. However, the cell population exposed to sub-saturating L-arabinose concentrations is divided into two subpopulations of induced and uninduced cells, which is determined by the differences between individual cells in the availability of L-arabinose transporter (Zhang et al., Development and Application of an Arabinose-Inducible Expression System by Facilitating Inducer Uptake in *Corynebacterium glutamicum*; Appl. Environ. Microbiol. August 2012 vol. 78 no. 16 5831-5838). Alternatively, inducible expression from the ParaBad can be controlled or fine-tuned through the optimization of the ribosome binding site (RBS), as described herein. An exemplary construct is depicted in FIG. 88C.

In one embodiment, expression of one or more anti-cancer moleculeprotein(s) of interest, e.g., one or more therapeutic polypeptide(s), is driven directly or indirectly by one or more arabinose inducible promoter(s).

In some embodiments, the arabinose inducible promoter is useful for or induced during in vivo expression of the one or more protein(s) of interest. In some embodiments, expression of one or more anti-cancer moleculeprotein(s) of interest is driven directly or indirectly by one or more arabinose inducible promoter(s) in vivo. In some embodiments, the promoter is directly or indirectly induced by a molecule that is co-administered with the genetically engineered bacteria of the invention, e.g., arabinose.

In some embodiments, expression of one or more protein(s) of interest, is driven directly or indirectly by one or more arabinose inducible promoter(s) during in vitro growth, preparation, or manufacturing of the strain prior to in vivo administration. In some embodiments, the arabinose inducible promoter(s) are induced in culture, e.g., grown in a flask, fermenter or other appropriate culture vessel, e.g., used during cell growth, cell expansion, fermentation, recovery, purification, formulation, and/or manufacture. In some embodiments, the promoter is directly or indirectly induced by a molecule that is added to in the bacterial culture to induce expression and pre-load the bacterium with the payload prior to administration, e.g., arabinose. In some embodiments, the cultures, which are induced by arabinose, are grown arerobically. In some embodiments, the cultures, which are induced by arabinose, are grown anaerobically.

In one embodiment, the arabinose inducible promoter drives the expression of a construct comprising one or more protein(s) of interest, jointly with a second promoter, e.g., a second constitutive or inducible promoter. In some embodiments, two promoters are positioned proximally to the construct and drive its expression, wherein the arabinose inducible promoter drives expression under a first set of exogenous conditions, and the second promoter drives the expression under a second set of exogenous conditions. In a non-limiting example, the first and second conditions may be two sequential culture conditions (i.e., during preparation of the culture in a flask, fermenter or other appropriate culture vessel, e.g., arabinose and IPTG). In another non-limiting example, the first inducing conditions may be culture conditions, e.g., including arabinose presence, and the second inducing conditions may be in vivo conditions. Such in vivo conditions include low-oxygen, microaerobic, or anaerobic conditions, conditions of the tumor microenvironment, presence of gut metabolites, and/or metabolites administered in combination with the bacterial strain. In some embodiments, the one or more arabinose promoters drive expression of one or more protein(s) of interest, in combination with the FNR promoter driving the expression of the same gene sequence(s).

In some embodiments, the arabinose inducible promoter drives the expression of one or more protein(s) of interest from a low-copy plasmid or a high copy plasmid or a biosafety system plasmid described herein. In some embodiments, the arabinose inducible promoter drives the expression of one or more protein(s) of interest from a construct which is integrated into the bacterial chromosome. Exemplary insertion sites are described herein.

In some embodiments, one or more protein(s) of interest are knocked into the arabinose operon and are driven by the native arabinose inducible promoter In some embodiments, the genetically engineered bacteria comprise one or more gene sequence(s) having at least 80%, 81%, 82%, 83%, 84%, 85%, 86%, 87%, 88%, 89%, 90%, 91%, 92%, 93%, 94%, 95%, 96%, 97%, 98%, or 99% identity with any of the sequences of SEQ ID NO: 585. In some embodiments, the arabinose inducible construct further comprises a gene encoding AraC, which is divergently transcribed from the same promoter as the one or more one or more protein(s) of interest. In some embodiments, the genetically engineered bacteria comprise one or more gene sequence(s) having at least 80%, 81%, 82%, 83%, 84%, 85%, 86%, 87%, 88%, 89%, 90%, 91%, 92%, 93%, 94%, 95%, 96%, 97%, 98%, or 99% identity with any of the sequences of SEQ ID NO: 586. In some embodiments, the genetically engineered bacteria comprise one or more gene sequence(s) encoding a polypeptide having at least 80%, 81%, 82%, 83%, 84%, 85%, 86%, 87%, 88%, 89%, 90%, 91%, 92%, 93%, 94%, 95%, 96%, 97%, 98%, or 99% identity with the polypeptide encoded by any of the sequences of SEQ ID NO: 587.

In some embodiments, the genetically engineered bacteria comprise one or more gene sequence(s) which are inducible through a rhamnose inducible system. The genes rhaBAD are organized in one operon which is controlled by the rhaP BAD promoter. The rhaP BAD promoter is regulated by two activators, RhaS and RhaR, and the corresponding genes belong to one transcription unit which divergently transcribed in the opposite direction of rhaBAD. In the presence of L-rhamnose, RhaR binds to the rhaP RS promoter and activates the production of RhaR and RhaS. RhaS together with L-rhamnose then bind to the rhaP BAD and the rhaP T promoter and activate the transcription of the structural genes. In contrast to the arabinose system, in which AraC is provided and divergently transcribed in the gene sequence (s), it is not necessary to express the regulatory proteins in larger quantities in the rhamnose expression system because the amounts expressed from the chromosome are sufficient to activate transcription even on multi-copy plasmids. Therefore, only the rhaP BAD promoter is cloned upstream of the gene that is to be expressed. Full induction of rhaBAD transcription also requires binding of the CRP-cAMP complex, which is a key regulator of catabolite repression. Alternatively, inducible expression from the rhaBAD can be controlled or fine-tuned through the optimization of the ribosome binding site (RBS), as described herein.

In one embodiment, expression of one or more protein(s) of interest is driven directly or indirectly by one or more rhamnose inducible promoter(s). In one embodiment, expression of the payload is driven directly or indirectly by a rhamnose inducible promoter.

In some embodiments, the rhamnose inducible promoter is useful for or induced during in vivo expression of the one or more protein(s) of interest. In some embodiments, expression of one or more protein(s) of interest is driven directly or indirectly by one or more rhamnose inducible promoter(s) in vivo. In some embodiments, the promoter is directly or indirectly induced by a molecule that is co-administered with the genetically engineered bacteria of the invention, e.g., rhamnose In some embodiments, expression of one or more protein (s) of interest, is driven directly or indirectly by one or more rhamnose inducible promoter(s) during in vitro growth, preparation, or manufacturing of the strain prior to in vivo administration. In some embodiments, the rhamnose inducible promoter(s) are induced in culture, e.g., grown in a flask, fermenter or other appropriate culture vessel, e.g., used during cell growth, cell expansion, fermentation, recovery, purification, formulation, and/or manufacture. In some embodiments, the promoter is directly or indirectly induced by a molecule that is added to in the bacterial culture to induce expression and pre-load the bacterium with the payload prior to administration, e.g., rhamnose. In some embodiments, the cultures, which are induced by rhamnose, are grown arerobically. In some embodiments, the cultures, which are induced by rhamnose, are grown anaerobically.

In one embodiment, the rhamnose inducible promoter drives the expression of a construct comprising one or more protein(s) of interest jointly with a second promoter, e.g., a second constitutive or inducible promoter. In some embodiments, two promoters are positioned proximally to the construct and drive its expression, wherein the rhamnose inducible promoter drives expression under a first set of exogenous conditions, and the second promoter drives the expression under a second set of exogenous conditions. In a non-limiting example, the first and second conditions may be two sequential culture conditions (i.e., during preparation of the culture in a flask, fermenter or other appropriate culture vessel, e.g., rhamnose and arabinose). In another non-limiting example, the first inducing conditions may be culture conditions, e.g., including rhamnose presence, and the second inducing conditions may be in vivo conditions. Such in vivo conditions include low-oxygen, microaerobic, or anaerobic conditions, conditions of the tumor microenvironment, presence of gut metabolites, and/or metabolites administered in combination with the bacterial strain. In some embodiments, the one or more rhamnose promoters drive expression of one or more protein(s) of interest and/or transcriptional regulator(s), e.g., FNRS24Y, in combination with the FNR promoter driving the expression of the same gene sequence(s).

In some embodiments, the rhamnose inducible promoter drives the expression of one or more protein(s) of interest, from a low-copy plasmid or a high copy plasmid or a biosafety system plasmid described herein. In some embodiments, the rhamnose inducible promoter drives the expression of one or more protein(s) of interest, from a construct which is integrated into the bacterial chromosome. Exemplary insertion sites are described herein.

In some embodiments, the genetically engineered bacteria comprise one or more gene sequence(s) having at least 80%, 81%, 82%, 83%, 84%, 85%, 86%, 87%, 88%, 89%, 90%, 91%, 92%, 93%, 94%, 95%, 96%, 97%, 98%, or 99% identity with any of the sequences of SEQ ID NO: 588.

In some embodiments, the genetically engineered bacteria comprise one or more gene sequence(s) which are inducible through an Isopropyl β-D-1-thiogalactopyranoside (IPTG) inducible system or other compound which induced transcription from the Lac Promoter. IPTG is a molecular mimic of allolactose, a lactose metabolite that activates transcription of the lac operon. In contrast to allolactose, the sulfur atom in IPTG creates a non-hydrolyzable chemical blond, which prevents the degradation of IPTG, allowing the concentration to remain constant. IPTG binds to the lac repressor and releases the tetrameric repressor (lacI) from the lac operator in an allosteric manner, thereby allowing the transcription of genes in the lac operon. Since IPTG is not metabolized by $E.$ $coli$, its concentration stays constant and the rate of expression of Lac promoter-controlled is tightly controlled, both in vivo and in vitro. IPTG intake is independent on the action of lactose permease, since other transport pathways are also involved. Inducible expression from the PLac can be controlled or fine-tuned through the optimization of the ribosome binding site (RBS), as described herein. Other compounds which inactivate LacI, can be used instead of IPTG in a similar manner.

In one embodiment, expression of one or more protein(s) of interest is driven directly or indirectly by one or more IPTG inducible promoter(s).

In some embodiments, the IPTG inducible promoter is useful for or induced during in vivo expression of the one or more protein(s) of interest. In some embodiments, expression of one or more protein(s) of interest is driven directly or indirectly by one or more IPTG inducible promoter(s) in vivo. In some embodiments, the promoter is directly or indirectly induced by a molecule that is co-administered with the genetically engineered bacteria of the invention, e.g., IPTG.

In some embodiments, expression of one or more protein (s) of interest is driven directly or indirectly by one or more IPTG inducible promoter(s) during in vitro growth, preparation, or manufacturing of the strain prior to in vivo administration. In some embodiments, the IPTG inducible promoter(s) are induced in culture, e.g., grown in a flask, fermenter or other appropriate culture vessel, e.g., used during cell growth, cell expansion, fermentation, recovery, purification, formulation, and/or manufacture. In some embodiments, the promoter is directly or indirectly induced by a molecule that is added to in the bacterial culture to induce expression and pre-load the bacterium with the payload prior to administration, e.g., IPTG. In some embodiments, the cultures, which are induced by IPTG, are grown arerobically. In some embodiments, the cultures, which are induced by IPTG, are grown anaerobically.

In one embodiment, the IPTG inducible promoter drives the expression of a construct comprising one or more protein(s) of interest jointly with a second promoter, e.g., a second constitutive or inducible promoter. In some embodiments, two promoters are positioned proximally to the construct and drive its expression, wherein the IPTG inducible promoter drives expression under a first set of exogenous conditions, and the second promoter drives the expression under a second set of exogenous conditions. In a non-limiting example, the first and second conditions may be two sequential culture conditions (i.e., during preparation of the culture in a flask, fermenter or other appropriate culture vessel, e.g., arabinose and IPTG). In another non-limiting example, the first inducing conditions may be culture conditions, e.g., including IPTG presence, and the second inducing conditions may be in vivo conditions. Such in vivo conditions include low-oxygen, microaerobic, or anaerobic conditions, conditions of the tumor microenvironment, presence of gut metabolites, and/or metabolites administered in combination with the bacterial strain. In some embodiments, the one or more IPTG inducible promoters drive expression of one or more protein(s) of interest in combination with the FNR promoter driving the expression of the same gene sequence(s).

In some embodiments, the IPTG inducible promoter drives the expression of one or more protein(s) of interest from a low-copy plasmid or a high copy plasmid or a biosafety system plasmid described herein. In some embodiments, the IPTG inducible promoter drives the expression of one or more protein(s) of interest from a construct which is integrated into the bacterial chromosome. Exemplary insertion sites are described herein.

In some embodiments, the genetically engineered bacteria comprise one or more gene sequence(s) having at least 80%, 81%, 82%, 83%, 84%, 85%, 86%, 87%, 88%, 89%, 90%, 91%, 92%, 93%, 94%, 95%, 96%, 97%, 98%, or 99% identity with any of the sequences of SEQ ID NO: 589. In some embodiments, the IPTG inducible construct further comprises a gene encoding lacI, which is divergently transcribed from the same promoter as the one or more one or more protein(s) of interest. In some embodiments, the genetically engineered bacteria comprise one or more gene sequence(s) having at least 80%, 81%, 82%, 83%, 84%, 85%, 86%, 87%, 88%, 89%, 90%, 91%, 92%, 93%, 94%, 95%, 96%, 97%, 98%, or 99% identity with any of the sequences of SEQ ID NO: 590. In some embodiments, the genetically engineered bacteria comprise one or more gene sequence(s) encoding a polypeptide having at least 80%, 81%, 82%, 83%, 84%, 85%, 86%, 87%, 88%, 89%, 90%, 91%, 92%, 93%, 94%, 95%, 96%, 97%, 98%, or 99% identity with the polypeptide encoded by any of the sequences of SEQ ID NO: 591.

In some embodiments, the genetically engineered bacteria comprise one or more gene sequence(s) which are inducible through a tetracycline inducible system. The initial system Gossen and Bujard (Tight control of gene expression in mammalian cells by tetracycline-responsive promoters. Gossen M & Bujard H. $PNAS,$ 1992 Jun. 15; 89(12):5547-51) developed is known as tetracycline off: in the presence of tetracycline, expression from a tet-inducible promoter is reduced. Tetracycline-controlled transactivator (tTA) was created by fusing tetR with the C-terminal domain of VP16 (virion protein 16) from herpes simplex virus. In the absence of tetracycline, the tetR portion of tTA will bind tetO sequences in the tet promoter, and the activation domain promotes expression. In the presence of tetracycline, tetracycline binds to tetR, precluding tTA from binding to the tetO sequences. Next, a reverse Tet repressor (rTetR), was developed which created a reliance on the presence of tetracycline for induction, rather than repression. The new transactivator rtTA (reverse tetracycline-controlled transactivator) was created by fusing rTetR with VP16. The tetracycline on system is also known as the rtTA-dependent system.

In one embodiment, expression of one or more protein(s) of interest is driven directly or indirectly by one or more tetracycline inducible promoter(s).

In some embodiments, the tetracycline inducible promoter is useful for or induced during in vivo expression of the one or more protein(s) of interest. In some embodiments, expression of one or more protein(s) of interest and/or transcriptional regulator(s), e.g., FNRS24Y, is driven directly or indirectly by one or more tetracycline inducible promoter(s) in vivo. In some embodiments, the promoter is directly or indirectly induced by a molecule that is co-administered with the genetically engineered bacteria of the invention, e.g., tetracycline In some embodiments, expression of one or more protein(s) of interest is driven directly or indirectly by one or more tetracycline inducible promoter(s) during in vitro growth, preparation, or manufacturing of the strain prior to in vivo administration. In some embodiments, the tetracycline inducible promoter(s) are induced in culture, e.g., grown in a flask, fermenter or other appropriate culture vessel, e.g., used during cell growth, cell expansion, fermentation, recovery, purification, formulation, and/or manufacture. In some embodiments, the promoter is directly or indirectly induced by a molecule that is added to in the bacterial culture to induce expression and pre-load the bacterium with the payload prior to administration, e.g., tetracycline. In some embodiments, the cultures, which are induced by tetracycline, are grown arerobically. In some embodiments, the cultures, which are induced by tetracycline, are grown anaerobically.

In one embodiment, the tetracycline inducible promoter drives the expression of a construct comprising one or more protein(s) of interest jointly with a second promoter, e.g., a second constitutive or inducible promoter. In some embodiments, two promoters are positioned proximally to the construct and drive its expression, wherein the tetracycline inducible promoter drives expression under a first set of exogenous conditions, and the second promoter drives the expression under a second set of exogenous conditions. In a non-limiting example, the first and second conditions may be two sequential culture conditions (i.e., during preparation of the culture in a flask, fermenter or other appropriate culture vessel, e.g., tetracycline and IPTG). In another non-limiting example, the first inducing conditions may be culture conditions, e.g., including tetracycline presence, and the second inducing conditions may be in vivo conditions. Such in vivo conditions include low-oxygen, microaerobic, or anaerobic conditions, conditions of the tumor microenvironment, presence of gut metabolites, and/or metabolites administered in combination with the bacterial strain. In some embodiments, the one or more tetracycline promoters drive expression of one or more protein(s) of interest in combination with the FNR promoter driving the expression of the same gene sequence(s).

In some embodiments, the tetracycline inducible promoter drives the expression of one or more protein(s) of interest from a low-copy plasmid or a high copy plasmid or a biosafety system plasmid described herein. In some embodiments, the tetracycline inducible promoter drives the expression of one or more protein(s) of interest from a construct which is integrated into the bacterial chromosome. Exemplary insertion sites are described herein.

In some embodiments, the genetically engineered bacteria comprise one or more gene sequence(s) having at least 80%, 81%, 82%, 83%, 84%, 85%, 86%, 87%, 88%, 89%, 90%, 91%, 92%, 93%, 94%, 95%, 96%, 97%, 98%, or 99% identity with any of the bolded sequences of SEQ ID NO: 596 (tet promoter is in bold). In some embodiments, the tetracycline inducible construct further comprises a gene encoding AraC, which is divergently transcribed from the same promoter as the one or more one or more protein(s) of interest In some embodiments, the genetically engineered bacteria comprise one or more gene sequence(s) having at least 80%, 81%, 82%, 83%, 84%, 85%, 86%, 87%, 88%, 89%, 90%, 91%, 92%, 93%, 94%, 95%, 96%, 97%, 98%, or 99% identity with any of the sequences of SEQ ID NO: 596 in italics (Tet repressor is in italics). In some embodiments, the genetically engineered bacteria comprise one or more gene sequence(s) encoding a polypeptide having at least 80%, 81%, 82%, 83%, 84%, 85%, 86%, 87%, 88%, 89%, 90%, 91%, 92%, 93%, 94%, 95%, 96%, 97%, 98%, or 99% identity with the polypeptide encoded by any of the sequences of SEQ ID NO: 596 in italics (Tet repressor is in italics).

In some embodiments, the genetically engineered bacteria comprise one or more gene sequence(s) whose expression is controlled by a temperature sensitive mechanism. Thermoregulators are advantageous because of strong transcriptional control without the use of external chemicals or specialized media (see, e.g., Nemani et al., Magnetic nanoparticle hyperthermia induced cytosine deaminase expression in microencapsulated *E. coli* for enzyme-prodrug therapy; J Biotechnol. 2015 Jun. 10; 203: 32-40, and references therein). Thermoregulated protein expression using the mutant cI857 repressor and the pL and/or pR phage λ promoters have been used to engineer recombinant bacterial strains. The gene of interest cloned downstream of the λ promoters can then be efficiently regulated by the mutant thermolabile cI857 repressor of bacteriophage λ. At temperatures below 37° C., cI857 binds to the oL or oR regions of the pR promoter and blocks transcription by RNA polymerase. At higher temperatures, the functional cI857 dimer is destabilized, binding to the oL or oR DNA sequences is abrogated, and mRNA transcription is initiated. An exemplary construct is depicted in FIG. 88A. Inducible expression from the ParaBad can be controlled or further fine-tuned through the optimization of the ribosome binding site (RBS), as described herein.

In one embodiment, expression of one or more protein(s) of interest is driven directly or indirectly by one or more thermoregulated promoter(s).

In some embodiments, the thermoregulated promoter is useful for or induced during in vivo expression of the one or more protein(s) of interest. In some embodiments, expression of one or more protein(s) of interest is driven directly or indirectly by one or more thermoregulated promoter(s) in vivo. In some embodiments, the promoter is directly or indirectly induced by a molecule that is co-administered with the genetically engineered bacteria of the invention, e.g., temperature.

In some embodiments, expression of one or more protein(s) of interest is driven directly or indirectly by one or more thermoregulated promoter(s) during in vitro growth, preparation, or manufacturing of the strain prior to in vivo administration. In some embodiments, it may be advantageous to shup off production of the one or more protein(s) of interest. This can be done in a thermoregulated system by growing the strain at lower temperatures, e.g., 30 C. Expression can then be induced by elevating the temperature to 37 C and/or 42 C. In some embodiments, the thermoregulated promoter(s) are induced in culture, e.g., grown in a flask, fermenter or other appropriate culture vessel, e.g., used during cell growth, cell expansion, fermentation, recovery, purification, formulation, and/or manufacture. In some embodiments, the cultures, which are induced by temperatures between 37 C and 42 C, are grown arerobically. In some embodiments, the cultures, which are induced by induced by temperatures between 37 C and 42 C, are grown anaerobically.

In one embodiment, the thermoregulated promoter drives the expression of a construct comprising one or more protein(s) of interest jointly with a second promoter, e.g., a second constitutive or inducible promoter. In some embodiments, two promoters are positioned proximally to the construct and drive its expression, wherein the thermoregulated promoter drives expression under a first set of exogenous conditions, and the second promoter drives the expression under a second set of exogenous conditions. In a non-limiting example, the first and second conditions may be two sequential culture conditions (i.e., during preparation of the culture in a flask, fermenter or other appropriate culture vessel, e.g., thermoregulation and arabinose). In another non-limiting example, the first inducing conditions may be culture conditions, e.g., permissive temperature, and the second inducing conditions may be in vivo conditions. Such in vivo conditions include low-oxygen, microaerobic, or anaerobic conditions, conditions of the tumor microenvironment, presence of gut metabolites, and/or metabolites administered in combination with the bacterial strain. In some embodiments, the one or more thermoregulated promoters drive expression of one or more protein(s) of interest in combination with the FNR promoter driving the expression of the same gene sequence(s).

In some embodiments, the thermoregulated promoter drives the expression of one or more protein(s) of interest from a low-copy plasmid or a high copy plasmid or a biosafety system plasmid described herein. In some embodiments, the thermoregulated promoter drives the expression of one or more protein(s) of interest from a construct which is integrated into the bacterial chromosome. Exemplary insertion sites are described herein.

In some embodiments, the genetically engineered bacteria comprise one or more gene sequence(s) having at least 80%, 81%, 82%, 83%, 84%, 85%, 86%, 87%, 88%, 89%, 90%, 91%, 92%, 93%, 94%, 95%, 96%, 97%, 98%, or 99% identity with any of the sequences of SEQ ID NO: 592. In some embodiments, the thermoregulated construct further comprises a gene encoding mutant cI857 repressor, which is divergently transcribed from the same promoter as the one or more one or more protein(s) of interest. In some embodiments, the genetically engineered bacteria comprise one or more gene sequence(s) having at least 80%, 81%, 82%, 83%, 84%, 85%, 86%, 87%, 88%, 89%, 90%, 91%, 92%, 93%, 94%, 95%, 96%, 97%, 98%, or 99% identity with any of the sequences of SEQ ID NO: 593. In some embodiments, the genetically engineered bacteria comprise one or more gene sequence(s) encoding a polypeptide having at least 80%, 81%, 82%, 83%, 84%, 85%, 86%, 87%, 88%, 89%, 90%, 91%, 92%, 93%, 94%, 95%, 96%, 97%, 98%, or 99% identity with the polypeptide encoded by any of the sequences of SEQ ID NO: 595.

In some embodiments, the genetically engineered bacteria comprise one or more gene sequence(s) which are indirectly inducible through a system driven by the PssB promoter. The Pssb promoter is active under aerobic conditions, and shuts off under anaerobic conditions.

This promoter can be used to express a gene of interest under aerobic conditions. This promoter can also be used to tightly control the expression of a gene product such that it is only expressed under anaerobic conditions. In this case, the oxygen induced PssB promoter induces the expression of a repressor, which represses the expression of a gene of interest. As a result, the gene of interest is only expressed in the absence of the repressor, i.e., under anaerobic conditions. This strategy has the advantage of an additional level of control for improved fine-tuning and tighter control. FIG. 89A depicts a schematic of the gene organization of a PssB promoter.

In one embodiment, expression of one or more protein(s) of interest is indirectly regulated by a repressor expressed under the control of one or more PssB promoter(s).

In some embodiments, induction of the RssB promoter(s) indirectly drives the in vivo expression of one or more protein(s) of interest. In some embodiments, induction of the RssB promoter(s) indirectly drives the expression of one or more protein(s) of interest during in vitro growth, preparation, or manufacturing of the strain prior to in vivo administration. In some embodiments, conditions for induction of the RssB promoter(s) are provided in culture, e.g., in a flask, fermenter or other appropriate culture vessel, e.g., used during cell growth, cell expansion, fermentation, recovery, purification, formulation, and/or manufacture.

In some embodiments, the PssB promoter indirectly drives the expression of one or more protein(s) of interest from a low-copy plasmid or a high copy plasmid or a biosafety system plasmid described herein. In some embodiments, the PssB promoter indirectly drives the expression of one or more protein(s) of interest from a construct which is integrated into the bacterial chromosome. Exemplary insertion sites are described herein.

In another non-limiting example, this strategy can be used to control expression of thyA and/or dapA, e.g., to make a conditional auxotroph. The chromosomal copy of dapA or ThyA is knocked out. Under anaerobic conditions, dapA or thyA—as the case may be—are expressed, and the strain can grow in the absence of dap or thymidine. Under aerobic conditions, dapA or thyA expression is shut off, and the strain cannot grow in the absence of dap or thymidine. Such a strategy can, for example be employed to allow survival of bacteria under anaerobic conditions, e.g., the gut or conditions of the tumor microenvironment, but prevent survival under aerobic conditions (bio safety switch). In some embodiments, the genetically engineered bacteria comprise one or more gene sequence(s) having at least 80%, 81%, 82%, 83%, 84%, 85%, 86%, 87%, 88%, 89%, 90%, 91%, 92%, 93%, 94%, 95%, 96%, 97%, 98%, or 99% identity with any of the sequences of SEQ ID NO: 597.

Sequences useful for expression from inducible promoters are listed in Table 43.

TABLE 43

Inducible promoter construct sequences

| Description | Sequence |
|---|---|
| Arabinose Promoter region SEQ ID NO: 585 | CAGACATTGCCGTCACTGCGTCTTTTACTGGCTCTTCTCGC TAACCCAACCGGTAACCCCGCTTATTAAAAGCATTCTGTA ACAAAGCGGGACCAAAGCCATGACAAAAACGCGTAACAA AAGTGTCTATAATCACGGCAGAAAAGTCCACATTGATTAT TTGCACGGCGTCACACTTTGCTATGCCATAGCATTTTTATC CATAAGATTAGCGGATCCAGCCTGACGCTTTTTTTCGCAA CTCTCTACTGTTTCTCCATACCTCTAGAAATAATTTTGTTT AACTTTAAGAAGGAGATATACAT |
| AraC (reverse orientation) SEQ ID NO: 586 | TTATTCACAACCTGCCCTAAACTCGCTCGGACTCGCCCCG GTGCATTTTTTAAATACTCGCGAGAAATAGAGTTGATCGT CAAAACCGACATTGCGACCGACGGTGGCGATAGGCATCC GGGTGGTGCTCAAAAGCAGCTTCGCCTGACTGATGCGCTG GTCCTCGCGCCAGCTTAATACGCTAATCCCTAACTGCTGG CGGAACAAATGCGACAGACGCGACGGCGACAGGCAGACA TGCTGTGCGACGCTGGCGATATCAAAATTACTGTCTGCCA GGTGATCGCTGATGTACTGACAAGCCTCGCGTACCCGATT ATCCATCGGTGGATGGAGCGACTCGTTAATCGCTTCCATG CGCCGCAGTAACAATTGCTCAAGCAGATTTATCGCCAGCA ATTCCGAATAGCGCCCTTCCCCTTGTCCGGCATTAATGATT TGCCCAAACAGGTCGCTGAAATGCGGCTGGTGCGCTTCAT CCGGGCGAAAGAAACCGGTATTGGCAAATATCGACGGCC AGTTAAGCCATTCATGCCAGTAGGCGCGCGGACGAAAGT AAACCCACTGGTGATACCATTCGTGAGCCTCCGGATGACG ACCGTAGTGATGAATCTCTCCAGGCGGGAACAGCAAAAT ATCACCCGGTCGGCAGACAAATTCTCGTCCCTGATTTTTCA CCACCCCTGACCGCGAATGGTGAGATTGAGAATATAACC TTTCATTCCCAGCGGTCGGTCGATAAAAAAATCGAGATAA CCGTTGGCCTCAATCGGCGTTAAACCCGCCACCAGATGGG CGTTAAACGAGTATCCCGGCAGCAGGGGATCATTTTGCGC TTCAGCCATACTTTTCATACTCCCGCCATTCAGAGAAGAA ACCAATTGTCCATATTGCAT |
| AraC polypeptide SEQ ID NO: 587 | MQYGQLVSSLNGGSMKSMAEAQNDPLLPGYSFNAHLVAGL TPIEANGYLDFFIDRPLGMKGYILNLTIRGQGVVKNQGREFV CRPGDILLFPPGEIHHYGRHPEAHEWYHQWVYFRPRAYWHE WLNWPSIFANTGFFRPDEAHQPHFSDLFGQIINAGQGEGRYS ELLAINLLEQLLLRRMEAINESLHPPMDNRVREACQYISDHL ADSNFDIASVAQHVCLSPSRLSHLFRQQLGISVLSWREDQRIS QAKLLLSTTRMPIATVGRNVGFDDQLYFSRVFKKCTGASPSE FRAGCE* |
| Region comprising rhamnose inducible promoter SEQ ID NO: 588 | CGGTGAGCATCACATCACCACAATTCAGCAAATTGTGAAC ATCATCACGTTCATCTTTCCCTGGTTGCCAATGGCCCATTT TCCTGTCAGTAACGAGAAGGTCGCGAATCAGGCGCTTTTT AGACTGGTCGTAATGAAATTCAGCTGTCACCGGATGTGCT TTCCGGTCTGATGAGTCCGTGAGGACGAAACAGCCTCTAC AAATAATTTTGTTTAAAACAACACCCACTAAGATAACTCT AGAAATAATTTTGTTTAACTTTAAGAAGGAGATATACAT |
| Lac Promoter region SEQ ID NO: 589 | ATTCACCACCCTGAATTGACTCTCTTCCGGGCGCTATCATG CCATACCGCGAAAGGTTTTGCGCCATTCGATGGCGCGCCG CTTCGTCAGGCCACATAGCTTTCTTGTTCTGATCGGAACGA TCGTTGGCTGTGTTGACAATTAATCATCGGCTCGTATAATG TGTGGAATTGTGAGCGCTCACAATTAGCTGTCACCGGATG TGCTTTCCGGTCTGATGAGTCCGTGAGGACGAAACAGCCT CTACAAATAATTTTGTTTAAAACAACACCCACTAAGATAA CTCTAGAAATAATTTTGTTTAACTTTAAGAAGGAGATATA CAT |
| LacO | GGAATTGTGAGCGCTCACAATT |
| LacI (in reverse orientation) SEQ ID NO: 590 | TCACTGCCCGCTTTCCAGTCGGGAAACCTGTCGTGCCAGC TGCATTAATGAATCGGCCAACGCGCGGGGAGAGGCGGTTT GCGTATTGGGCGCCAGGGTGGTTTTTCTTTTCACCAGTGA GACTGGCAACAGCTGATTGCCCTTCACCGCCTGGCCCTGA GAGAGTTGCAGCAAGCGGTCCACGCTGGTTTGCCCCAGCA GGCGAAAATCCTGTTTGATGGTGGTTAACGGCGGGATATA ACATGAGCTATCTTCGGTATCGTCGTATCCCACTACCGAG ATATCCGCACCAACGCGCAGCCCGGACTCGGTAATGGCGC GCATTGCGCCCAGCGCCATCTGATCGTTGGCAACCAGCAT CGCAGTGGGAACGATGCCCTCATTCAGCATTTGCATGGTT TGTTGAAAACCGGACATGGCACTCCAGTCGCCTTCCCGTT CCGCTATCGGCTGAATTTGATTGCGAGTGAGATATTTATG CCAGCCAGCCAGACGCAGACGCGCCGAGACAGAACTTAA TGGGCCCGCTAACAGCGCGATTTGCTGGTGACCCAATGCG |

TABLE 43-continued

Inducible promoter construct sequences

| Description | Sequence |
|---|---|
| | ACCAGATGCTCCACGCCCAGTCGCGTACCGTCCTCATGGG<br>AGAAAATAATACTGTTGATGGGTGTCTGGTCAGAGACATC<br>AAGAAATAACGCCGGAACATTAGTGCAGGCAGCTTCCAC<br>AGCAATGGCATCCTGGTCATCCAGCGGATAGTTAATGATC<br>AGCCCACTGACGCGTTGCGCGAGAAGATTGTGCACCGCCG<br>CTTTACAGGCTTCGACGCCGCTTCGTTCTACCATCGACACC<br>ACCACGCTGGCACCCAGTTGATCGGCGCGAGATTTAATCG<br>CCGCGACAATTTGCGACGGCGCGTGCAGGGCCAGACTGG<br>AGGTGGCAACGCCAATCAGCAACGACTGTTTGCCCGCCAG<br>TTGTTGTGCCACGCGGTTGGGAATGTAATTCAGCTCCGCC<br>ATCGCCGCTTCCACTTTTTCCCGCGTTTTCGCAGAAACGTG<br>GCTGGCCTGGTTCACCACGCGGGAAACGGTCTGATAAGAG<br>ACACCGGCATACTCTGCGACATCGTATAACGTTACTGGTT<br>TCAT |
| LacI polypeptide sequence SEQ ID NO: 591 | MKPVTLYDVAEYAGVSYQTVSRVVNQASHVSAKTREKVEA<br>AMAELNYIPNRVAQQLAGKQSLLIGVATSSLALHAPSQIVAA<br>IKSRADQLGASVVVSMVERSGVEACKAAVHNLLAQRVSGLI<br>INYPLDDQDAIAVEAACTNVPALFLDVSDQTPINSIIFSHEDGT<br>RLGVEHLVALGHQQIALLAGPLSSVSARLRLAGWHKYLTRN<br>QIQPIAEREGDWSAMSGFQQTMQMLNEGIVPTAMLVANDQ<br>MALGAMRAITESGLRVGADISVVGYDDTEDSSCYIPPLTTIK<br>QDFRLLGQTSVDRLLQLSQGQAVKGNQLLPVSLVKRKTTLA<br>PNTQTASPRALADSLMQLARQVSRLESGQ |
| Region comprising Temperature sensitive promoter SEQ ID NO: 592 | ACGTTAAATCTATCACCGCAAGGGATAAATATCTAACACC<br>GTGCGTGTTGACTATTTTACCTCTGGCGGTGATAATGGTTG<br>CATAGCTGTCACCGGATGTGCTTTCCGGTCTGATGAGTCC<br>GTGAGGACGAAACAGCCTCTACAAATAATTTTGTTTAAAA<br>CAACACCCACTAAGATAACTCTAGAAATAATTTTGTTTAA<br>CTTTAAGAAGGAGATATACAT |
| mutant cI857 repressor SEQ ID NO: 593 | TCAGCCAAACGTCTCTTCAGGCCACTGACTAGCGATAACT<br>TTCCCCACAACGGAACAACTCTCATTGCATGGGATCATTG<br>GGTACTGTGGGTTTAGTGGTTGTAAAAACACCTGACCGCT<br>ATCCCTGATCAGTTTCTTGAAGGTAAACTCATCACCCCCA<br>AGTCTGGCTATGCAGAAATCACCTGGCTCAACAGCCTGCT<br>CAGGGTCAACGAGAATTAACATTCCGTCAGGAAAGCTTGG<br>CTTGGAGCCTGTTGGTGCGGTCATGGAATTACCTTCAACC<br>TCAAGCCAGAATGCAGAATCACTGGCTTTTTTGGTTGTGC<br>TTACCCATCTCTCCGCATCACCTTTGGTAAAGGTTCTAAGC<br>TTAGGTGAGAACATCCCTGCCTGAACATGAGAAAAAACA<br>GGGTACTCATACTCACTTCTAAGTGACGGCTGCATACTAA<br>CCGCTTCATACATCTCGTAGATTTCTCTGGCGATTGAAGG<br>GCTAAATTCTTCAACGCTAACTTTGAGAATTTTTGTAAGCA<br>ATGCGGCGTTATAAGCATTTAATGCATTGATGCCATTAAA<br>TAAAGCACCAACGCCTGACTGCCCCATCCCCATCTTGTCT<br>GCGACAGATTCCTGGGATAAGCCAAGTTCATTTTTCTTTTT<br>TTCATAAATTGCTTTAAGGCGACGTGCGTCCTCAAGCTGC<br>TCTTGTGTTAATGGTTTCTTTTTTGTGCTCAT |
| RBS and leader region SEQ ID NO: 594 | CTCTAGAAATAATTTTGTTTAACTTTAAGAAGGAGATATA<br>CAT |
| mutant cI857 repressor polypeptide sequence SEQ ID NO: 595 | MSTKKKPLTQEQLEDARRLKAIYEKKKNELGLSQESVADKM<br>GMGQSGVGALFNGINALNAYNAALLTKILKVSVEEFSPSIAR<br>EIYEMYEAVSMQPSLRSEYEYPVFSHVQAGMFSPKLRTFTKG<br>DAERWVSTTKKASDSAFWLEVEGNSMTAPTGSKPSFPDGML<br>ILVDPEQAVEPGDFCIARLGGDEFTFKKLIRDSGQVFLQPLNP<br>QYPMIPCNESCSVVGKVIASQWPEETFG |
| TetR-Tet promoter construct SEQ ID NO: 596 | *Ttaagacccactttcacatttaagttgttttctaatccgcatatgatcaattcaaggccgaataa<br>gaaggctggctctgcaccttggtgatcaaataattcgatagcttgtcgtaataatggcggcata<br>ctatcagtagtaggtgtttcccttctcttagcgacttgatgctcttgatcttccaatacgcaacct<br>aaagtaaaatgccccacagcgctgagtgcatataatgcattctctagtgaaaaaccttgttgg<br>cataaaaaggctaattgattttcgagagtttcatactgtttttctgtaggccgtgtacctaaatgta<br>cttttgctccatcgcgatgacttagtaaagcacatctaaaacttttagcgttattacgtaaaaaat<br>cttgccagctttcccccttctaaagggcaaaagtgagtatggtgcctatctaacatctcaatggct<br>aaggcgtcgagcaaagcccgcttatttttacatgccaatacaatgtaggctgctctacaccta<br>gcttctgggcgagtttacggggttgttaaaccttcgattccgacctcattaagcagctctaatgcg<br>ctgttaatcactttacttttatctaatctagacatcattaattcctaattttt*gttgacactctatcattg<br>atagagttatttaccactccctatcagtgatagagaaa*aagtgaa*ctctagaaataatttgttt<br>aactttaagaaggagatatacat* |

TABLE 43-continued

Inducible promoter construct sequences

| Description | Sequence |
|---|---|
| PssB promoter SEQ ID NO: 597 | tcacctttcccggattaaacgcttttttgcccggtggcatggtgctaccggcgatcacaaacggtta attatgacacaaattgacctgaatgaatatacagtattggaatgcattacccggagtgttgtgtaac aatgtctggccaggtttgtttcccggaaccgaggtcacaacatagtaaaagcgctattggtaatgg tacaatcgcgcgtttacacttattc |

Cancer-Specific and Tissue-Specific Promoters

In some embodiments, promoters that are active in cancers, or active in specific types of cancers can be used to drive the expression of the anti-cancer molecule(s). Tissue-specific promoters are able to improve the specific gene delivery to tumor tissue, and reduce amount of transgene expressed in normal tissues (e.g., reviewed in Toth et al., 2010 (Oncolytic (replication-competent) adenoviruses as anticancer agents Expert Opin. Biol. Ther. 2010, 10(3)). A large number of tumor-specific promoters have been employed in gene therapy approaches. For example, the hTERT promoter has been used to drive cancer-specific expression in a number different types of cancer tissues. The alpha-fetoprotein (AFP) and the erb2 promoters have been used to target hepatic cancer and breast cancer, respectively. Several promoters, including carcinoembryonic antigen (CEA), cyclooxygenase-2 (COX-2), hTERT, and Urokinase-type plasminogen activator receptor (uPAR) have been used to direct suicide genes into colorectal carcinoma cells (Rama et al., Disease Markers (2015). The tables below include a number of promoters that are tumor specific or tissue-specific and can be used to drive expression in cancers or certain cancer types.

In some embodiments, the promoter is an inducible promoter, such as hypoxia-inducible promoter. In some embodiments promoter contains one or more hypoxia inducible elements (HRE). Hypoxia-inducible factor-1 (HIF-1) and HIF-2 play critical roles in cellular response to hypoxia. The stabilization and activation of HIF-1 is perhaps the most characterized molecular response to hypoxia. HIF-1 is a heterodimer composed of the HIF-1☐☐ subunit and the HIF-1 subunit. HIF-1 and HIF-2a can bind to HREs within the promoters of multiple tumor-promoting and adaptive genes to activate their expression. In some embodiments, the hypoxia inducible promoter can drive the expression of a gene or genes encoding one or more anti-cancer molecules. Several transgenes have been successfully expressed under the control of a hypoxia-inducible promoter, e.g., p53 for induction of apoptosis, HSV thymidine kinase, bacterial nitroreductase, VEGF receptor 1-Ig, CD40 ligand, and IL-4 (see, e.g., Guo, Virus Adaptation and Treatment 2011:3 71-82 The impact of hypoxia on oncolytic virotherapy).

In some embodiments, for example wherein the engineered microorganism is an engineered OV, the hypoxia inducible promoter can drive the expression of a gene essential for replication and/or the transgene of interest, e.g., a gene encoding an anti-cancer molecule. As a non-limiting example, a genetically engineered OV, e.g., an adenovirus, may include an HRE containing promoter, which drives the expression of the early region 1A (E1A) gene, allowing the virus to replicate only under hypoxic conditions. In some embodiments, the genetically engineered OV may combine the use of a tumor-specific promoter with a hypoxia specific promoter to drive the expression of replication essential genes, providing an additional level of control and fine-tuning. Such a dual-regulated oncolytic adenovirus, in which the hTERT gene promoter controls the E1A gene and a hypoxia-responsive promoter controls the E1B gene showed increased safety with preserved antitumoral efficacy (Zhang et al. Increased safety with preserved antitumoral efficacy on hepatocellular carcinoma with dual-regulated oncolytic adenovirus. Clin Cancer Res. 2006; 12(21): 6523-6531).

Oncolytic Virus Promoters

As another non-limiting example, viral promoters can be used to fine-tune the timing of expression of a gene of interest. In a non-limiting example, viral late promoters can be used to regulate timing and levels of expression. In a non-limiting example, the US11 promoter can be used. The use of the US11 true late HSV promoter was used to express TNFalpha in a CP34.5 deleted, oncolytic herpes simplex virus (HSV) and was able to delay TNFalpha expression as compared to a CMV promoter and increase localized TNFalpha expression (Han et al., J Gene Med. 2007 February; 9(2):99-106). In another non-limiting example, the UL38p promoter can be used. This promoter has been shown to be minimally active in normal nondividing cells, where the oncolytic HSV has limited ability to replicate. However, in tumor or cycling cells where the virus can fully replicate, transgene expression from UL38p was almost as high as from the cytomegalovirus immediate-early promoter (Fu et al., Gene Ther. 2003 August; 10(17):1458-64. A strict-late viral promoter is a strong tumor-specific promoter in the context of an oncolytic herpes simplex virus).

In other embodiments, a viral promoter driving a gene essential for replication is replaced with a tumor specific promoter. As a non-limiting example, the E1A promoter is exchanged with a cancer-specific promoter. Without wishing to be bound by theory, such an oncolytic adenoviruses will replicate only in cells in which the ectopic promoter is active, because the E1A protein is needed for the transcriptional activation of other early viral genes in these adenoviral vectors. For example, two distinct tumor-specific promoters (DF3/Muc1 and hTERT) were used drive separate E1A expression cassettes to address tumor heterogeneity in a gliosarcoma mouse model. The resulting adenovirus, which also had a deletion of the viral E1B region, induced higher levels of E1A oncoprotein, enhanced oncolysis and generated an earlier and higher apoptotic index in infected tumor cells (Doloff et al. Cancer Gene Ther. 2011 March; 18(3):153-66; Dual E1A oncolytic adenovirus: targeting tumor heterogeneity with two independent cancer-specific promoter elements, DF3/MUC1 and hTERT).

In another non-limiting example, E4 or E2 gene promoters may be used in a similar manner. The table below shows tumor-specific and tissue specific promoters that have been used in oncolytic adenoviral therapies to drive expression of a gene of interest or a gene essential to the replication of the oncolytic virus.

In other embodiments, an inducible promoter can be used to drive the gene of interest. For example, non-replicative adenovirus vectors have been used to deliver TNFalpha directly to the tumor under the control of a radiation sensitive promoter (Han et al., J Gene Med. 2007 February; 9(2):99-106). In one embodiment, the OV may be delivering radioisotopic treatment into infected cells. In another embodiment, the OV may be applied in combination with radiotherapy (radiovirotherapy), with or without a replication essential gene and/or atransgene under the control of a radiation senstitive promoter, as described in Touchefeu et al. (Curr Pharm Des. 2012; 18(22):3313-20. Radiovirotherapy: principles and prospects in oncology).

In some embodiments, the genetically engineered OVs of the invention contain a tetracycline or doxycycline-inducible promoter system, comprising a tetracycline repressor, several promoter constructs, and a tet operator sequence. In the absence of doxycycline, the tetracycline represses transcription from this promoter. In the presence of doxycycline, repression through the Tet repressor is relieved and transcription is induced. In some embodiments, the OV is a oncolytic recombinant vaccinia virus (rVACV), as described in Stritzker et al. (Stritzker et al., J Virol. 2014 October; 88(19): 11556-11567. Inducible Gene Expression in Tumors Colonized by Modified Oncolytic Vaccinia Virus Strains). In some embodiments, the doxycycline inducible promoter drives the expression of a replication essential gene. In other embodiments, the doxycycline-inducible promoter drives the expression of a transgene of interest. In other embodiments, any inducible system known in the art can be used to drive regulatable, inducible expression of the OV, including but not limited to rapamycin or estrogen inducible systems.

TABLE 44

Tumor specific promoters

| | |
|---|---|
| AFP | Hepatocellular carcinoma |
| HRE enhancer; AFP promoter | Hepatocellular carcinomas |
| Albumin | hepatocellular carcinoma |
| CCKAR | Pancreatic cancer |
| CEA | Epithelial cancers |
| c-erbB2 | Breast & pancreatic cancer |
| COX-2 | Many tumors |
| CXCR4 | Many tumors |
| E2F-1 | Many tumors |
| HE4 | Many tumors |
| LP | Many tumors |
| MUC1 | Carcinoma cells |
| PSA | Prostate and prostate cancers |
| Survivin | Many tumors |
| TRP1 | Melanocytes and melanoma |
| Tyrosine | Melanocytes and melanoma |
| SV40 | Many tumors |
| TERT | Cancer-specific |
| Glial fibrillary acidic protein (GFAP) | Glial/glioma |
| Myelin basic protein (MBP) | Glial and astocytes/glioma |
| Myelin proteolipid protein | Glial/glioma |
| Thyroglobulin | thyroid carcinomas |
| HRE, PGK-1 enhancer; E-selectin, KDR | Endothelial cancers |
| HSP70 | Cancer |
| WAP | Breast cancer |
| ppET1 | Endothelial cancers |
| AFP enhancer; PGK promoter | Hepatocellular carcinomas |

TABLE 45

Promoters used to target oncolytic Ads to a certain cell population

| Promoter | Cell type |
|---|---|
| Prostate-specific antigen (PSA) | Prostate |
| AFP | Hepatocellular carcinoma |
| Kallikrein | Prostate cancer |
| Estrogen response element (ERE) | Breast cancer |
| MUC-1 | Breast cancer |
| Surfactant protein B (SPB) | Clara cells in lung |
| T cell factor (TCF) | Colon cancer, breast cancer |
| Osteocalcin | Bone metastasis of prostate cancer |
| Midkine | Ewing sarcoma, neuroblastoma |
| Endoglin | Neovasculature |
| Uroplakin | Bladder cancer |
| E2F-1 | Dividing cells |
| Hypoxia inducible factor (HIF-1) | Hypoxic cells |
| Tyrosinase | Melanoma |
| L-Plastin | Breast cancer, melanoma |
| Telomerase reverse transcriptase (TERT) | Cancer cells |
| COX-2 | Gastrointestinal cancer |
| Carcinoembryonic antigen (CEA) | Cancer cells |
| Survivin | Breast cancer |
| Progression-elevated gene (PEG-3) | Pancreatic cancer |
| Ki67 | Neuroblastoma |
| Mesothelin | Ovarian cancer |
| Chromogranin | Midgut carcinoid |

TABLE 46

Tissue-specific promoters used in cancer gene therapy

| Promoter | Target tissue/tumour |
|---|---|
| Tyrosinase | Melanocytes/melanoma |
| Prostate-specific antigen (PSA) | Prostate |
| Prostate-specific membrane antigen (PSMA) | Prostate/also targets vascular endothelium of other tumours |
| Probasin | Prostate |
| Human glandular kallikrein (hK2) | Prostate |
| Neural specific enolase | Neuronal/SCLC |
| Neuronal specific synapsin 1 | Neuronal |
| Ncx/Hox11L.1 | Neural crest derived cells/neurobalstoma |
| Albumin | Liver/hepatocellular carcinoma |
| Surfactant protein B | Type II alveolar and bronchial cells/lung cancer |
| Thyroglobulin | Thyroid/thyroid carcinomas |
| Ovarian-specific promoter | Ovarian |
| SPA1 | Lung |
| PEPCK promoter | Hepatocyte |
| hAAT | Hepatocyte |
| MMTV-LTR | Mammary gland |
| MCK promoter | Muscle |
| Col1a1 promoter | Bone |
| HS2 of erythroid-specific GATA-1 gene; HIV-1 promoter | Mature erythroblasts |

TABLE 47

Comparison of Selected Ubiquitous and Cell-specific Promoters.

| Promoter | Specificity | Relative Strength | Size (bps) | Reference(s) |
|---|---|---|---|---|
| CMV | Ubiquitous | +++ | 750-800 | Xu et al., 2001; Gray et al., 2011 |
| CBA (including derivatives: CAG, CBh, etc.) | Ubiquitous | +++ | 248-1,600 | Klein et al., 2002; Ohlfest et al., 2005; Gray et al., 2011 |
| EF-1α | Ubiquitous | ++ | 2,500 | Gill et al., 2001; Xu et al., 2001; Ikeda et al., 2002; Gilham et al., 2010 |
| PGK | Ubiquitous | ++ | 426 | Gilham et al., 2010 |
| UBC | Ubiquitous | + | 403 | Gill et al., 2001; Qin et al., 2010 |
| GUSB (hGBp) | Ubiquitous | + | 378 | Husain et al., 2009 |
| UCOE (Promoter of HNRPA2B1-CBX3) | Ubiquitous | ++ | 600-2,500 | Antoniou et al., 2013 |
| hAAT | Liver | ++ | 347-1,500 | Van Linthout et al., 2002; Cunningham et al., 2008 |
| TBG | Liver | ++ | 400 | Yan et al., 2012 |
| Desmin | Skeletal muscle | +++ | 1,700 | Talbot et al., 2010 |
| MCK | Skeletal muscle | ++ | 595-1,089 | Wang et al., 2008; Talbot et al., 2010; Katwal et al., 2013 |
| C5-12 | Skeletal, cardiac, and diaphragm | ++ | 312 | Wang et al., 2008 |
| NSE | Neuron | +++ | 300-2,200 | Xu et al., 2001 |
| Synapsin | Neuron | + | 470 | Kügler et al., 2003; Hioki et al., 2007; Kuroda et al., 2008 |
| PDGF | Neuron | +++ | 1,400 | Patterna et al., 2000; Hioki et al., 2007 |
| MecP2 | Neuron | + | 229 | Rastegar et al., 2009; Gray et al., 2011 |
| CaMKII | Neuron | ++ | 364-2,300 | Hioki et al., 2007; Kuroda et al., 2008 |
| mGluR2 | Neuron | + | 1,400 | Brené et al., 2000; Kuroda et al., 2008 |
| NFL | Neuron | + | 650 | Xu et al., 2001 |
| NFH | Neuron | + | 920 | Xu et al., 2001 |
| nβ2 | Neuron | + | 650 | Xu et al., 2001 |
| PPE | Neuron | + | 2,700 | Xu et al., 2001 |
| Enk | Neuron | + | 412 | Xu et al., 2001 |
| EAAT2 | Neuron and astrocyte | ++ | 966 | Su et al., 2003; Kuroda et al., 2008 |
| GFAP | Astrocyte | ++ | 681-2,200 | Brenner et al., 1994; Xu et al., 2001; Lee et al., 2008; Dirren et al., 2014 |
| MBP | Oligodendrocytes | ++ | 1,900 | Chen et al., 1998 |

Note:
Cell type specificity, relative strength (+ being the weakest and +++ being the strongest), size, and relevant references for commonly used promoters.

In some embodiments, the genetically engineered bacteria comprise a stably maintained plasmid or chromosome carrying a gene for producing an anti-cancer molecule, such that the anti-cancer molecule can be expressed in the host cell, and the host cell is capable of survival and/or growth in vitro, e.g., in medium, and/or in vivo, e.g., in a tumor and/or necrotic tissues. In some embodiments, a bacterium may comprise multiple copies of the gene encoding the anti-cancer molecule. In some embodiments, the gene encoding the anti-cancer molecule is expressed on a low-copy plasmid. In some embodiments, the low-copy plasmid may be useful for increasing stability of expression. In some embodiments, the low-copy plasmid may be useful for decreasing leaky expression under non-inducing conditions. In some embodiments, the gene encoding the anti-cancer molecule is expressed on a high-copy plasmid. In some embodiments, the high-copy plasmid may be useful for increasing In some embodiments, the bacteria are genetically engineered to include multiple mechanisms of action (MOAs), e.g., circuits producing multiple copies of the same product (e.g., to enhance copy number) or circuits performing multiple different functions. For example, the genetically engineered bacteria may include four copies of the gene encoding the single-chain PD-1 antibody inserted at four different insertion sites. Alternatively, the genetically engineered bacteria may include three copies of the gene encoding the single-chain PD-1 antibody inserted at three different insertion sites and three copies of the gene encoding the single-chain CTLA-4 antibody inserted at three different insertion sites.

Constitutive Promoters

In some embodiments, the gene encoding the payload is present on a plasmid and operably linked to a constitutive promoter. In some embodiments, the gene encoding the payload is present on a chromosome and operably linked to a constitutive promoter.

In some embodiments, the constitutive promoter is active under in vivo conditions, e.g., the gut and/or conditions of the tumor microenvironment, as described herein. In some embodiments, the promoters is active under in vitro conditions, e.g., various cell culture and/or cell manufacturing conditions, as described herein. In some embodiments, the constitutive promoter is active under in vivo conditions, e.g., the gut and/or conditions of the tumor microenvironment, as described herein, and under in vitro conditions, e.g., various cell culture and/or cell production and/or manufacturing conditions, as described herein.

In some embodiments, the constitutive promoter that is operably linked to the gene encoding the payload is active in various exogenous environmental conditions (e.g., in vivo and/or in vitro and/or production/manufacturing conditions).

In some embodiments, the constitutive promoter is active in exogenous environmental conditions specific to the gut of a mammal and/or conditions of the tumor microenvironment. In some embodiments, the constitutive promoter is active in exogenous environmental conditions specific to the small intestine of a mammal. In some embodiments, the constitutive promoter is active in low-oxygen or anaerobic conditions such as the environment of the mammalian gut and/or conditions of the tumor microenvironment. In some embodiments, the constitutive promoter is active in the presence of molecules or metabolites that are specific to the gut of a mammal and/or conditions of the tumor microenvironment. In some embodiments, the constitutive promoter is directly or indirectly induced by a molecule that is co-administered with the bacterial cell. In some embodiments, the constitutive promoter is active in the presence of molecules or metabolites or other conditions, that are present during in vitro culture, cell production and/or manufacturing conditions.

Bacterial constitutive promoters are known in the art. Exemplary constitutive promoters are listed in the following Tables.

TABLE 48

Constitutive *E. coli* σ70 promoters

| Name | Description | Promoter Sequence | Length |
|---|---|---|---|
| BBa_I14018 SEQ ID NO: 598 | P(Bla) | ... gtttatacataggcgagtactctgttatgg | 35 |
| BBa_I14033 SEQ ID NO: 599 | P(Cat) | ... agaggttccaactttcaccataatgaaaca | 38 |
| BBa_I14034 SEQ ID NO: 600 | P(Kat) | ... taaacaactaacggacaattctacctaaca | 45 |
| BBa_I732021 SEQ ID NO: 601 | Template for Building Primer Family Member | ... acatcaagccaaattaaacaggattaacac | 159 |
| BBa_I742126 SEQ ID NO: 602 | Reverse lambda cI-regulated promoter | ... gaggtaaaatagtcaacacgcacggtgtta | 49 |
| BBa_J01006 SEQ ID NO: 603 | Key Promoter absorbs 3 | ... caggccggaataactccctataatgcgcca | 59 |
| BBa_J23100 SEQ ID NO: 604 | constitutive promoter family member | ... ggctagctcagtcctaggtacagtgctagc | 35 |
| BBa_J23101 SEQ ID NO: 605 | constitutive promoter family member | ... agctagctcagtcctaggtattatgctagc | 35 |
| BBa_J23102 SEQ ID NO: 606 | constitutive promoter family member | ... agctagctcagtcctaggtactgtgctagc | 35 |
| BBa_J23103 SEQ ID NO: 607 | constitutive promoter family member | ... agctagctcagtcctagggattatgctagc | 35 |
| BBa_J23104 SEQ ID NO: 608 | constitutive promoter family member | ... agctagctcagtcctaggtattgtgctagc | 35 |
| BBa_J23105 SEQ ID NO: 609 | constitutive promoter family member | ... ggctagctcagtcctaggtactatgctagc | 35 |
| BBa_J23106 SEQ ID NO: 610 | constitutive promoter family member | ... ggctagctcagtcctaggtatagtgctagc | 35 |
| BBa_J23107 SEQ ID NO: 611 | constitutive promoter family member | ... ggctagctcagccctaggtattatgctagc | 35 |
| BBa_J23108 SEQ ID NO: 612 | constitutive promoter family member | ... agctagctcagtcctaggtataatgctagc | 35 |
| BBa_J23109 SEQ ID NO: 613 | constitutive promoter family member | ... agctagctcagtcctagggactgtgctagc | 35 |

TABLE 48-continued

Constitutive *E. coli* σ70 promoters

| Name | Description | Promoter Sequence | Length |
|---|---|---|---|
| BBa_J23110 SEQ ID NO: 614 | constitutive promoter family member | ... ggctagctcagtcctaggtacaatgctagc | 35 |
| BBa_J23111 SEQ ID NO: 615 | constitutive promoter family member | ... ggctagctcagtcctaggtatagtgctagc | 35 |
| BBa_J23112 SEQ ID NO: 616 | constitutive promoter family member | ... agctagctcagtcctagggattatgctagc | 35 |
| BBa_J23113 SEQ ID NO: 617 | constitutive promoter family member | ... ggctagctcagtcctagggattatgctagc | 35 |
| BBa_J23114 SEQ ID NO: 618 | constitutive promoter family member | ... ggctagctcagtcctaggtacaatgctagc | 35 |
| BBa_J23115 SEQ ID NO: 619 | constitutive promoter family member | ... agctagctcagcccttggtacaatgctagc | 35 |
| BBa_J23116 SEQ ID NO: 620 | constitutive promoter family member | ... agctagctcagtcctagggactatgctagc | 35 |
| BBa_J23117 SEQ ID NO: 621 | constitutive promoter family member | ... agctagctcagtcctagggattgtgctagc | 35 |
| BBa_J23118 SEQ ID NO: 622 | constitutive promoter family member | ... ggctagctcagtcctaggtattgtgctagc | 35 |
| BBa_J23119 SEQ ID NO: 623 | constitutive promoter family member | ... agctagctcagtcctaggtataatgctagc | 35 |
| BBa_J23150 SEQ ID NO: 624 | 1 bp mutant from J23107 | ... ggctagctcagtcctaggtattatgctagc | 35 |
| BBa_J23151 SEQ ID NO: 625 | 1 bp mutant from J23114 | ... ggctagctcagtcctaggtacaatgctagc | 35 |
| BBa_J44002 SEQ ID NO: 626 | pBAD reverse | ... aaagtgtgacgccgtgcaaataatcaatgt | 130 |
| BBa_J48104 SEQ ID NO: 627 | NikR promoter, a protein of the ribbon helix-helix family of trancription factors that repress expre | ... gacgaatacttaaaatcgtcatacttattt | 40 |
| BBa_J54200 SEQ ID NO: 628 | lacq_Promoter | ... aaaccttttcgcggtatggcatgatagcgcc | 50 |
| BBa_J56015 SEQ ID NO: 629 | lacIQ-promoter sequence | ... tgatagcgcccggaagagagtcaattcagg | 57 |
| BBa_J64951 SEQ ID NO: 630 | E. coli CreABCD phosphate sensing operon promoter | ... ttatttaccgtgacgaactaattgctcgtg | 81 |
| BBa_K088007 SEQ ID NO: 631 | GlnRS promoter | ... catacgccgttatacgttgtttacgctttg | 38 |

TABLE 48-continued

Constitutive *E. coli* σ70 promoters

| Name | Description | Promoter Sequence | Length |
|---|---|---|---|
| BBa_K119000 SEQ ID NO: 632 | Constitutive weak promoter of lacZ | ...ttatgcttccggctcgtatgttgtgtggac | 38 |
| BBa_K119001 SEQ ID NO: 633 | Mutated LacZ promoter | ...ttatgcttccggctcgtatggtgtgtggac | 38 |
| BBa_K1330002 SEQ ID NO: 634 | Constitutive promoter (J23105) | ...ggctagctcagtcctaggtactatgctagc | 35 |
| BBa_K137029 SEQ ID NO: 635 | constitutive promoter with (TA)10 between -10 and -35 elements | ...atatatatatatatataatggaagcgtttt | 39 |
| BBa_K137030 SEQ ID NO: 636 | constitutive promoter with (TA)9 between -10 and -35 elements | ...atatatatatatatataatggaagcgtttt | 37 |
| BBa_K137031 SEQ ID NO: 637 | constitutive promoter with (C)10 between -10 and -35 elements | ...ccccgaaagcttaagaatataattgtaagc | 62 |
| BBa_K137032 SEQ ID NO: 638 | constitutive promoter with (C)12 between -10 and -35 elements | ...ccccgaaagcttaagaatataattgtaagc | 64 |
| BBa_K137085 SEQ ID NO: 639 | optimized (TA) repeat constitutive promoter with 13 bp between -10 and -35 elements | ...tgacaatatatatatatatataatgctagc | 31 |
| BBa_K137086 SEQ ID NO: 640 | optimized (TA) repeat constitutive promoter with 15 bp between -10 and -35 elements | ...acaatatatatatatatataatgctagc | 33 |
| BBa_K137087 SEQ ID NO: 641 | optimized (TA) repeat constitutive promoter with 17 bp between -10 and -35 elements | ...aatatatatatatatatataatgctagc | 35 |
| BBa_K137088 SEQ ID NO: 642 | optimized (TA) repeat constitutive promoter with 19 bp between -10 and -35 elements | ...tatatatatatatatatataatgctagc | 37 |
| BBa_K137089 SEQ ID NO: 643 | optimized (TA) repeat constitutive promoter with 21 bp between -10 and -35 elements | ...tatatatatatatatatataatgctagc | 39 |
| BBa_K137090 SEQ ID NO: 644 | optimized (A) repeat constitutive promoter with 17 bp between -10 and -35 elements | ...aaaaaaaaaaaaaaaaatataatgctagc | 35 |
| BBa_K137091 SEQ ID NO: 645 | optimized (A) repeat constitutive promoter with 18 bp between -10 and -35 elements | ...aaaaaaaaaaaaaaaaatataatgctagc | 36 |
| BBa_K1585100 SEQ ID NO: 646 | Anderson Promoter with lacI binding site | ...ggaattgtgagcggataacaatttcacaca | 78 |
| BBa_K1585101 SEQ ID NO: 647 | Anderson Promoter with lacI binding site | ...ggaattgtgagcggataacaatttcacaca | 78 |
| BBa_K1585102 SEQ ID NO: 648 | Anderson Promoter with lacI binding site | ...ggaattgtgagcggataacaatttcacaca | 78 |

TABLE 48-continued

Constitutive *E. coli* σ70 promoters

| Name | Description | Promoter Sequence | Length |
|---|---|---|---|
| BBa_K1585103 SEQ ID NO: 649 | Anderson Promoter with lacI binding site | ... ggaattgtgagcggataacaatttcacaca | 78 |
| BBa_K1585104 SEQ ID NO: 650 | Anderson Promoter with lacI binding site | ... ggaattgtgagcggataacaatttcacaca | 78 |
| BBa_K1585105 SEQ ID NO: 651 | Anderson Promoter with lacI binding site | ... ggaattgtgagcggataacaatttcacaca | 78 |
| BBa_K1585106 SEQ ID NO: 652 | Anderson Promoter with lacI binding site | ... ggaattgtgagcggataacaatttcacaca | 78 |
| BBa_K1585110 SEQ ID NO: 653 | Anderson Promoter with lacI binding site | ... ggaattgtgagcggataacaatttcacaca | 78 |
| BBa_K1585113 SEQ ID NO: 654 | Anderson Promoter with lacI binding site | ... ggaattgtgagcggataacaatttcacaca | 78 |
| BBa_K1585115 SEQ ID NO: 655 | Anderson Promoter with lacI binding site | ... ggaattgtgagcggataacaatttcacaca | 78 |
| BBa_K1585116 SEQ ID NO: 656 | Anderson Promoter with lacI binding site | ... ggaattgtgagcggataacaatttcacaca | 78 |
| BBa_K1585117 SEQ ID NO: 657 | Anderson Promoter with lacI binding site | ... ggaattgtgagcggataacaatttcacaca | 78 |
| BBa_K1585118 SEQ ID NO: 658 | Anderson Promoter with lacI binding site | ... ggaattgtgagcggataacaatttcacaca | 78 |
| BBa_K1585119 SEQ ID NO: 659 | Anderson Promoter with lacI binding site | ... ggaattgtgagcggataacaatttcacaca | 78 |
| BBa_K1824896 SEQ ID NO: 660 | J23100 + RBS | ... gattaaagaggagaaatactagagtactag | 88 |
| BBa_K256002 SEQ ID NO: 661 | J23101:GFP | ... caccttcgggtgggcctttctgcgtttata | 918 |
| BBa_K256018 SEQ ID NO: 662 | J23119:IFP | ... caccttcgggtgggcctttctgcgtttata | 1167 |
| BBa_K256020 SEQ ID NO: 663 | J23119:HO1 | ... caccttcgggtgggcctttctgcgtttata | 949 |
| BBa_K256033 SEQ ID NO: 664 | Infrared signal reporter (J23119:IFP:J23119:HO1) | ... caccttcgggtgggcctttctgcgtttata | 2124 |
| BBa_K292000 SEQ ID NO: 665 | Double terminator + constitutive promoter | ... ggctagctcagtcctaggtacagtgctagc | 138 |
| BBa_K292001 SEQ ID NO: 666 | Double terminator + Constitutive promoter + Strong RBS | ... tgctagctactagagattaaagaggagaaa | 161 |
| BBa_K418000 SEQ ID NO: 667 | IPTG inducible Lac promoter cassette | ... ttgtgagcggataacaagatactgagcaca | 1416 |

TABLE 48-continued

Constitutive E. coli σ70 promoters

| Name | Description | Promoter Sequence | Length |
| --- | --- | --- | --- |
| BBa_K418002 SEQ ID NO: 668 | IPTG inducible Lac promoter cassette | ...ttgtgagcggataacaagatactgagcaca | 1414 |
| BBa_K418003 SEQ ID NO: 669 | IPTG inducible Lac promoter cassette | ...ttgtgagcggataacaagatactgagcaca | 1416 |
| BBa_K823004 SEQ ID NO: 670 | Anderson promoter J23100 | ...ggctagctcagtcctaggtacagtgctagc | 35 |
| BBa_K823005 SEQ ID NO: 671 | Anderson promoter J23101 | ...agctagctcagtcctaggtattatgctagc | 35 |
| BBa_K823006 SEQ ID NO: 672 | Anderson promoter J23102 | ...agctagctcagtcctaggtactgtgctagc | 35 |
| BBa_K823007 SEQ ID NO: 673 | Anderson promoter J23103 | ...agctagctcagtcctagggattatgctagc | 35 |
| BBa_K823008 SEQ ID NO: 674 | Anderson promoter J23106 | ...ggctagctcagtcctaggtatagtgctagc | 35 |
| BBa_K823010 SEQ ID NO: 675 | Anderson promoter J23113 | ...ggctagctcagtcctagggattatgctagc | 35 |
| BBa_K823011 SEQ ID NO: 676 | Anderson promoter J23114 | ...ggctagctcagtcctaggtacaatgctagc | 35 |
| BBa_K823013 SEQ ID NO: 677 | Anderson promoter J23117 | ...agctagctcagtcctagggattgtgctagc | 35 |
| BBa_K823014 SEQ ID NO: 678 | Anderson promoter J23118 | ...ggctagctcagtcctaggtattgtgctagc | 35 |
| BBa_M13101 SEQ ID NO: 679 | M13K07 gene I promoter | ...cctgttttatgttattctctctgtaaagg | 47 |
| BBa_M13102 SEQ ID NO: 680 | M13K07 gene II promoter | ...aaatatttgcttatacaatcttcctgtttt | 48 |
| BBa_M13103 SEQ ID NO: 681 | M13K07 gene III promoter | ...gctgataaaccgatacaattaaaggctcct | 48 |
| BBa_M13104 SEQ ID NO: 682 | M13K07 gene IV promoter | ...ctcttctcagcgtcttaatctaagctatcg | 49 |
| BBa_M13105 SEQ ID NO: 683 | M13K07 gene V promoter | ...atgagccagttcttaaaatcgcataaggta | 50 |
| BBa_M13106 SEQ ID NO: 684 | M13K07 gene VI promoter | ...ctattgattgtgacaaaataaacttattcc | 49 |
| BBa_M13108 SEQ ID NO: 685 | M13K07 gene VIII promoter | ...gtttcgcgcttggtataatcgctggggtc | 47 |
| BBa_M13110 SEQ ID NO: 686 | M13110 | ...ctttgcttctgactataatagtcagggtaa | 48 |

TABLE 48-continued

Constitutive *E. coli* σ70 promoters

| Name | Description | Promoter Sequence | Length |
|---|---|---|---|
| BBa_M31519 SEQ ID NO: 687 | Modified promoter sequence of g3. | ...aaaccgatacaattaaaggctcctgctagc | 60 |
| BBa_R1074 SEQ ID NO: 688 | Constitutive Promoter I | ...caccacactgatagtgctagtgtagatcac | 74 |
| BBa_R1075 SEQ ID NO: 689 | Constitutive Promoter II | ...gccggaataactccctataatgcgccacca | 49 |
| BBa_S03331 SEQ ID NO: 690 | --Specify Parts List-- | ttgacaagcttttcctcagctccgtaaact | |

TABLE 49

Constitutive *E. coli* σ$^S$ promoters

| Name | Description | Promoter Sequence | Length |
|---|---|---|---|
| BBa_J45992 SEQ ID NO: 691 | Full-length stationary phase osmY promoter | ...ggtttcaaaattgtgatc tatatttaacaa | 199 |
| BBa_J45993 SEQ ID NO: 692 | Minimal stationary phase osmY promoter | ...ggtttcaaaattgtgatc tatatttaacaa | 57 |

TABLE 50

Constitutive *E. coli* σ$^{32}$ promoters

| Name | Description | Promoter Sequence | Length |
|---|---|---|---|
| BBa_J45504 SEQ ID NO: 693 | htpG Heat Shock Promoter | ...tctattccaataaaga aatcttcctgcgtg | 405 |
| BBa_K1895002 SEQ ID NO: 694 | dnaK Promoter | ...gaccgaatatatagtg gaaacgtttagatg | 182 |
| BBa_K1895003 SEQ ID NO: 695 | htpG Promoter | ...ccacatcctgttttta accttaaaatggca | 287 |

TABLE 51

Constitutive *B. subtilis* σ$^A$ promoters

| Name | Description | Promoter Sequence | Length |
|---|---|---|---|
| BBa_K143012 SEQ ID NO: 696 | Promoter veg a constitutive promoter for *B. subtilis* | ...aaaaatgggctcgtgttgtacaataaatgt | 97 |
| BBa_K143013 SEQ ID NO: 697 | Promoter 43 a constitutive promoter for *B. subtilis* | ...aaaaaaagcgcgcgattatgtaaaatataa | 56 |
| BBa_K780003 SEQ ID NO: 698 | Strong constitutive promoter for *Bacillus subtilis* | ...aattgcagtaggcatgacaaaatggactca | 36 |
| BBa_K823000 SEQ ID NO: 699 | P$_{liaG}$ | ...caagcttttcctttataatagaatgaatga | 121 |
| BBa_K823002 SEQ ID NO: 700 | P$_{lepA}$ | ...tctaagctagtgtattttgcgtttaatagt | 157 |
| BBa_K823003 SEQ ID NO: 701 | P$_{veg}$ | ...aatgggctcgtgttgtacaataaatgtagt | 237 |

TABLE 52

Constitutive B. subtilis σ^B promoters

| Name | Description | Promoter Sequence | Length |
|---|---|---|---|
| BBa_K143010 SEQ ID NO: 702 | Promoter ctc for B. subtilis | ...atccttatcgttatgggtattgtttgtaat | 56 |
| BBa_K143011 SEQ ID NO: 703 | Promoter gsiB for B. subtilis | ...taaaagaattgtgagcgggaatacaacaac | 38 |
| BBa_K143013 SEQ ID NO: 704 | Promoter 43 a constitutive promoter for B. subtilis | ...aaaaaaagcgcgcgattatgtaaaatataa | 56 |

TABLE 53

Constitutive promoters from miscellaneous prokaryotes

| Name | Description | Promoter Sequence | Length |
|---|---|---|---|
| BBa_K112706 SEQ ID NO: 705 | Pspv2 from Salmonella | ...tacaaaataattcccctg caaacattatca | 474 |
| BBa_K112707 SEQ ID NO: 706 | Pspv from Salmonella | ...tacaaaataattcccctg caaacattatcg | 1956 |

TABLE 54

Constitutive promoters from bacteriophage T7

| Name | Description | Promoter Sequence | Length |
|---|---|---|---|
| BBa_I712074 SEQ ID NO: 707 | T7 promoter (strong promoter from T7 bacteriophage) | ...agggaatacaagctacttgttcttttgca | 46 |
| BBa_I719005 SEQ ID NO: 708 | T7 Promoter | taatacgactcactatagggaga | 23 |
| BBa_J34814 SEQ ID NO: 709 | T7 Promoter | gaatttaatacgactcactatagggaga | 28 |
| BBa_J64997 SEQ ID NO: 710 | T7 consensus -10 and rest | taatacgactcactatagg | 19 |
| BBa_K113010 SEQ ID NO: 711 | overlapping T7 promoter | ...gagtcgtattaatacgactcactatagggg | 40 |
| BBa_K113011 SEQ ID NO: 712 | more overlapping T7 promoter | ...agtgagtcgtactacgactcactatagggg | 37 |
| BBa_K113012 SEQ ID NO: 713 | weaken overlapping T7 promoter | ...gagtcgtattaatacgactctctatagggg | 40 |
| BBa_K1614000 SEQ ID NO: 714 | T7 promoter for expression of functional RNA | taatacgactcactatag | 18 |
| BBa_R0085 SEQ ID NO: 715 | T7 Consensus Promoter Sequence | taatacgactcactatagggaga | 23 |
| BBa_R0180 SEQ ID NO: 716 | T7 RNAP promoter | ttatacgactcactatagggaga | 23 |
| BBa_R0181 SEQ ID NO: 717 | T7 RNAP promoter | gaatacgactcactatagggaga | 23 |
| BBa_R0182 SEQ ID NO: 718 | T7 RNAP promoter | taatacgtctcactatagggaga | 23 |
| BBa_R0183 SEQ ID NO: 719 | T7 RNAP promoter | tcatacgactcactatagggaga | 23 |
| BBa_Z0251 SEQ ID NO: 720 | T7 strong promoter | ...taatacgactcactatagggagaccacaac | 35 |

TABLE 54-continued

Constitutive promoters from bacteriophage T7

| Name | Description | Promoter Sequence | Length |
|---|---|---|---|
| BBa_Z0252 SEQ ID NO: 721 | T7 weak binding and processivity | ... taattgaactcactaaagggagaccacagc | 35 |
| BBa_Z0253 SEQ ID NO: 722 | T7 weak binding promoter | ... cgaagtaatacgactcactatagggaaga | 35 |

TABLE 55

Constitutive promoters from bacteriophage SP6

| Name | Description | Promoter Sequence | Length |
|---|---|---|---|
| BBa_J64998 SEQ ID NO: 723 | consensus -10 and rest from SP6 | atttaggtgacactataga | 19 |

TABLE 56

Constitutive promoters from yeast

| Name | Description | Promoter Sequence | Length |
|---|---|---|---|
| BBa_I766555 SEQ ID NO: 724 | pCyc (Medium) Promoter | ... acaaacacaaatacacacactaaattaata | 244 |
| BBa_I766556 SEQ ID NO: 725 | pAdh (Strong) Promoter | ... ccaagcatacaatcaactatctcatataca | 1501 |
| BBa_I766557 SEQ ID NO: 726 | pSte5 (Weak) Promoter | ... gatacaggatacagcggaaacaactttttaa | 601 |
| BBa_J63005 SEQ ID NO: 727 | yeast ADH1 promoter | ... tttcaagctataccaagcatacaatcaact | 1445 |
| BBa_K105027 SEQ ID NO: 728 | cyc100 minimal promoter | ... cctttgcagcataaattactatacttctat | 103 |
| BBa_K105028 SEQ ID NO: 729 | cyc70 minimal promoter | ... cctttgcagcataaattactatacttctat | 103 |
| BBa_K105029 SEQ ID NO: 730 | cyc43 minimal promoter | ... cctttgcagcataaattactatacttctat | 103 |
| BBa_K105030 SEQ ID NO: 731 | cyc28 minimal promoter | ... cctttgcagcataaattactatacttctat | 103 |
| BBa_K105031 SEQ ID NO: 732 | cyc16 minimal promoter | ... cctttgcagcataaattactatacttctat | 103 |
| BBa_K122000 SEQ ID NO: 733 | pPGK1 | ... ttatctactttttacaacaaatataaaaca | 1497 |
| BBa_K124000 SEQ ID NO: 734 | pCYC Yeast Promoter | ... acaaacacaaatacacacactaaattaata | 288 |
| BBa_K124002 SEQ ID NO: 735 | Yeast GPD (TDH3) Promoter | ... gtttcgaataaacacacataaacaaacaaa | 681 |
| BBa_K319005 SEQ ID NO: 736 | yeast mid-length ADH1 promoter | ... ccaagcatacaatcaactatctcatataca | 720 |
| BBa_M31201 SEQ ID NO: 737 | Yeast CLB1 promoter region, G2/M cell cycle specific | ... accatcaaaggaagctttaatcttctcata | 500 |

TABLE 57

Constitutive promoters from miscellaneous eukaryotes

| Name | Description | Promoter Sequence | Length |
|---|---|---|---|
| BBa_I712004 SEQ ID NO: 738 | CMV promoter | . . . agaacccactgcttactggcttatcgaaat | 654 |
| BBa_K076017 SEQ ID NO: 739 | Ubc Promoter | . . . ggccgttttggctttttttgttagacgaag | 1219 |

TABLE 58

Promoters

| Name | Sequence | Description |
|---|---|---|
| Plpp SEQ ID NO: 740 | ataagtgccttcccatcaaaaaaatattctc aacataaaaaactttgtgtaatacttgtaac gcta | The Plpp promoter is a natural promoter taken from the Nissle genome. In situ it is used to drive production of lpp, which is known to be the most abundant protein in the cell. Also, in some previous RNAseq experiments I was able to confirm that the lpp mRNA is one of the most abundant mRNA in Nissle during exponential growth. |
| PapFAB46 SEQ ID NO: 741 | AAAAAGAGTATTGACTTC GCATCTTTTTGTACCTATA ATAGATTCATTGCTA | See, e.g., Kosuri, S., Goodman, D. B. & Cambray, G. Composability of regulatory sequences controlling transcription and translation in *Escherichia coli*. in 1-20 (2013). doi: 10.1073/pnas. |
| PJ2310 + UP element SEQ ID NO: 742 | ggaaaatttttttaaaaaaaaaactttacag ctagctcagtcctaggtattatgctagc | UP element helps recruit RNA polymerase (ggaaaatttttttaaaaaaaaaac) |
| PJ23107 + UP element SEQ ID NO: 743 | ggaaaatttttttaaaaaaaaaactttacgg ctagctcagccctaggtattatgctagc | UP element helps recruit RNA polymerase (ggaaaatttttttaaaaaaaaaac) |
| PSYN23119 SEQ ID NO: 744 | ggaaaatttttttaaaaaaaaaacTTGA CAGCTAGCTCAGTCCTTG GTATAATGCTAGCACGAA | UP element at 5' end; consensus −10 region is TATAAT; the consensus −35 is TTGACA; the extended −10 region is generally TGNTATAAT (TGGTATAAT in this sequence) |

In some embodiments, the constitutive promoter is at least about 80%, at least about 85%, at least about 90%, at least about 95%, or at least about 99% homologous to the sequence of any one of SEQ ID NOs: 598-744.

Ribosome Binding Sites

In some embodiments, ribosome binding sites are added, switched out or replaced. By testing a few ribosome binding sites, expression levels can be fine-tuned to the desired level. Table A and Table B lists a number RBS which are suitable for prokaryotic expression and can be used to achieve the desired expression levels (See, e.g., Registry of standard biological parts).

TABLE A

Selected Ribosome Binding Sites

| Identifier | Sequence$^a$ | SEQ ID NO |
|---|---|---|
| Master Sequence | TCTAGAGAAAGANNNGANNNACTAGATG | 1018 |
| BBa_J61100 | TCTAGAGAAAGAGGGGACAAACTAGATG | 1019 |
| BBa_J61101 | TCTAGAGAAAGACAGGACCCACTAGATG | 1020 |
| BBa_J61102 | TCTAGAGAAAGATCCGATGTACTAGATG | 1021 |
| BBa_J61103 | TCTAGAGAAAGATTAGACAAACTAGATG | 1022 |
| BBa_J61104 | TCTAGAGAAAGAAGGGACAGACTAGATG | 1023 |
| BBa_J61105 | TCTAGAGAAAGACATGACGTACTAGATG | 1024 |
| BBa_J61106 | TCTAGAGAAAGATAGGAGACACTAGATG | 1025 |
| BBa_J61107 | TCTAGAGAAAGAAGAGACTCACTAGATG | 1026 |
| BBa_J61108 | TCTAGAGAAAGACGAGATATACTAGATG | 1027 |

TABLE A-continued

Selected Ribosome Binding Sites

| Identifier | Sequence$^a$ | SEQ ID NO |
|---|---|---|
| BBa_J61109 | TCTAGAGAAAGACTGGAGACACTAGATG | 1028 |
| BBa_J61110 | TCTAGAGAAAGAGGCGAATTACTAGATG | 1029 |
| BBa_J61111 | TCTAGAGAAAGAGGCGATACACTAGATG | 1030 |
| BBa_J61112 | TCTAGAGAAAGAGGTGACATACTAGATG | 1031 |
| BBa_J61113 | TCTAGAGAAAGAGTGGAAAAACTAGATG | 1032 |
| BBa_J61114 | TCTAGAGAAAGATGAGAAGAACTAGATG | 1033 |
| BBa_J61115 | TCTAGAGAAAGAAGGGATACACTAGATG | 1034 |
| BBa_J61116 | TCTAGAGAAAGACATGAGGCACTAGATG | 1035 |
| BBa_J61117 | TCTAGAGAAAGACATGAGTTACTAGATG | 1036 |
| BBa_J61118 | TCTAGAGAAAGAGACGAATCACTAGATG | 1037 |
| BBa_J61119 | TCTAGAGAAAGATTTGATATACTAGATG | 1038 |
| BBa_J61120 | TCTAGAGAAAGACGCGAGAAACTAGATG | 1039 |
| BBa_J61121 | TCTAGAGAAAGAGACGAGTCACTAGATG | 1040 |
| BBa_J61122 | TCTAGAGAAAGAGAGGAGCCACTAGATG | 1041 |
| BBa_J61123 | TCTAGAGAAAGAGATGACTAACTAGATG | 1042 |
| BBa_J61124 | TCTAGAGAAAGAGCCGACATACTAGATG | 1043 |
| BBa_J61125 | TCTAGAGAAAGAGCCGAGTTACTAGATG | 1044 |
| BBa_J61126 | TCTAGAGAAAGAGGTGACTCACTAGATG | 1045 |
| BBa_J61127 | TCTAGAGAAAGAGTGGAACTACTAGATG | 1046 |
| BBa_J61128 | TCTAGAGAAAGATAGGACTCACTAGATG | 1047 |
| BBa_J61129 | TCTAGAGAAAGATTGGACGTACTAGATG | 1048 |
| BBa_J61130 | TCTAGAGAAAGAAACGACATACTAGATG | 1049 |
| BBa_J61131 | TCTAGAGAAAGAACCGAATTACTAGATG | 1050 |
| BBa_J61132 | TCTAGAGAAAGACAGGATTAACTAGATG | 873 |
| BBa_J61133 | TCTAGAGAAAGACCCGAGACACTAGATG | 869 |
| BBa_J61134 | TCTAGAGAAAGACCGGAAATACTAGATG | 870 |
| BBa_J61135 | TCTAGAGAAAGACCGGAGACACTAGATG | 871 |
| BBa_J61136 | TCTAGAGAAAGAGCTGAGCAACTAGATG | 874 |
| BBa_J61137 | TCTAGAGAAAGAGTAGATCAACTAGATG | 875 |
| BBa_J61138 | TCTAGAGAAAGATATGAATAACTAGATG | 876 |
| BBa_J61139 | TCTAGAGAAAGATTAGAGTCACTAGATG | 877 |

TABLE B

Selected Ribosome Binding Sites

| Identifier | Sequence$^a$ | SEQ ID NO |
|---|---|---|
| BBa_B0029 | TCTAGAGTTCACACAGGAAACCTACTAGATG | 880 |
| BBa_B0030 | TCTAGAGATTAAAGAGGAGAAATACTAGATG | 881 |
| BBa_B0031 | TCTAGAGTCACACAGGAAACCTACTAGATG | 882 |
| BBa_B0032 | TCTAGAGTCACACAGGAAAGTACTAGATG | 883 |
| BBa_B0033 | TCTAGAGTCACACAGGACTACTAGATG | 884 |
| BBa_B0034 | TCTAGAGAAAGAGGAGAAATACTAGATG | 885 |
| BBa_B0035 | TCTAGAGATTAAAGAGGAGAATACTAGATG | 886 |
| BBa_B0064 | TCTAGAGAAAGAGGGGAAATACTAGATG | 887 |

Induction of Payloads During Strain Culture

In some embodiments, it is desirable to pre-induce payload or protein of interest expression and/or payload activity prior to administration. Such payload or protein of interest may be an effector intended for secretion or may be an enzyme which catalyzes a metabolic reaction to produce an effector. In other embodiments, the protein of interest is an enzyme which catabolizes a harmful metabolite. In such situations, the strains are pre-loaded with active payload or protein of interest. In such instances, the genetically engineered bacteria of the invention express one or more protein (s) of interest, under conditions provided in bacterial culture during cell growth, expansion, purification, fermentation, and/or manufacture prior to administration in vivo. Such culture conditions can be provided in a flask, fermenter or other appropriate culture vessel, e.g., used during cell growth, cell expansion, fermentation, recovery, purification, formulation, and/or manufacture. As used herein, the term "bacterial culture" or bacterial cell culture" or "culture" refers to bacterial cells or microorganisms, which are maintained or grown in vitro during several production processes, including cell growth, cell expansion, recovery, purification, fermentation, and/or manufacture. As used herein, the term "fermentation" refers to the growth, expansion, and maintenance of bacteria under defined conditions. Fermentation may occur under a number of cell culture conditions, including anaerobic or low oxygen or oxygenated conditions, in the presence of inducers, nutrients, at defined temperatures, and the like.

Culture conditions are selected to achieve optimal activity and viability of the cells, while maintaining a high cell density (high biomass) yield. A number of cell culture conditions and operating parameters are monitored and adjusted to achieve optimal activity, high yield and high viability, including oxygen levels (e.g., low oxygen, microaerobic, aerobic), temperature of the medium, and nutrients and/or different growth media, chemical and/or nutritional inducers and other components provided in the medium. In some embodiments, phenylalanine is added to the media, e.g., to boost cell health. Without wishing to be bound by theory, addition of phenylalanine to the medium may prevent bacteria from catabolizing endogenously produced phenylalanine required for cell growth.

In some embodiments, the one or more protein(s) of interest and are directly or indirectly induced, while the strains is grown up for in vivo administration. Without wishing to be bound by theory, pre-induction may boost in vivo activity. This is particularly important in proximal regions of the gut which are reached first by the bacteria, e.g., the small intestine. If the bacterial residence time in this compartment is relatively short, the bacteria may pass through the small intestine without reaching full in vivo induction capacity. In contrast, if a strain is pre-induced and preloaded, the strains are already fully active, allowing for greater activity more quickly as the bacteria reach the intestine. Ergo, no transit time is "wasted", in which the strain is not optimally active. As the bacteria continue to move through the intestine, in vivo induction occurs under environmental conditions of the gut (e.g., low oxygen, or in the presence of gut metabolites).

In one embodiment, expression of one or more payload(s), is induced during cell growth, cell expansion, fermentation, recovery, purification, formulation, and/or manufacture. In one embodiment, expression of several different proteins of interest is induced during cell growth, cell expansion, fermentation, recovery, purification, formulation, and/or manufacture. In one embodiment, expression of one or more payload(s), is driven from the same promoter as a multicistronic message. In one embodiment, expression of one or more payload(s) is driven from the same promoter as two or more separate messages. In one embodiment, expression of one or more payload(s) is driven from the one or more different promoters.

In some embodiments, the strains are administered without any pre-induction protocols during strain growth prior to in vivo administration.

Anaerobic Induction

In some embodiments, cells are induced under anaerobic or low oxygen conditions in culture. In such instances, cells are grown (e.g., for 1.5 to 3 hours) until they have reached a certain OD, e.g., ODs within the range of 0.1 to 10, indicating a certain density e.g., ranging from $1\times10^8$ to $1\times10^{11}$, and exponential growth and are then switched to anaerobic or low oxygen conditions for approximately 3 to 5 hours. In some embodiments, strains are induced under anaerobic or low oxygen conditions, e.g. to induce FNR promoter activity and drive expression of one or more payload(s) and/or transporters under the control of one or more FNR promoters.

In one embodiment, expression of one or more payload(s), is under the control of one or more FNR promoter(s) and is induced during cell growth, cell expansion, fermentation, recovery, purification, formulation, and/or manufacture under anaerobic or low oxygen conditions. In one embodiment, expression of several different proteins of interest is under the control of one or more FNR promoter(s) and is induced during cell growth, cell expansion, fermentation, recovery, purification, formulation, and/or manufacture under anaerobic or low oxygen conditions.

In one embodiment, expression of two or more payload(s), is under the control of one or more FNR promoter(s) and is driven from the same promoter in the form of a multicistronic message under anaerobic or low oxygen conditions. In one embodiment, expression of one or more payload(s), is under the control of one or more FNR promoter(s) and is driven from the same promoter as two or more separate messages under anaerobic or low oxygen conditions. In one embodiment, expression of one or more payload(s under the control of one or more FNR promoter(s) and is driven from the one or more different promoters under anaerobic or low oxygen conditions.

Without wishing to be bound by theory, strains that comprise one or more payload(s) under the control of an FNR promoter, may allow expression of payload(s) from these promoters in vitro, under anaerobic or low oxygen culture conditions, and in vivo, under the low oxygen conditions found in the gut and/or conditions of the tumor microenvironment.

In some embodiments, promoters inducible by arabinose, IPTG, rhamnose, tetracycline, and/or other chemical and/or nutritional inducers can be induced under anaerobic or low oxygen conditions in the presence of the chemical and/or nutritional inducer. In particular, strains may comprise a combination of gene sequence(s), some of which are under control of FNR promoters and others which are under control of promoters induced by chemical and/or nutritional inducers. In some embodiments, strains may comprise one or more payload gene sequence(s) under the control of one or more FNR promoter(s) and one or more payload gene sequence(s) and/or transporter gene sequence(s) and/or transcriptional regulator gene sequence(s) under the control of a one or more promoter(s) which are induced by a one or more chemical and/or nutritional inducer(s), including, but not limited to, arabinose, IPTG, rhamnose, tetracycline, and/or other chemical and/or nutritional inducers described herein or known in the art. In some embodiments, strains may comprise one or more payload gene sequence(s) and/or under the control of one or more FNR promoter(s), and one or more payload gene sequence(s) under the control of a one or more constitutive promoter(s) described herein. In some embodiments, strains may comprise one or more payload gene sequence(s) under the control of an FNR promoter and one or more payload gene sequence(s) under the control of a one or more thermoregulated promoter(s) described herein.

In one embodiment, expression of one or more Payload is under the control of one or more promoter(s) regulated by chemical and/or nutritional inducers and is induced during cell growth, cell expansion, fermentation, recovery, purification, formulation, and/or manufacture under anaerobic and/or low oxygen conditions. In one embodiment, the chemical and/or nutritional inducer is arabinose and the promoter is inducible by arabinose. In one embodiment, the chemical and/or nutritional inducer is IPTG and the promoter is inducible by IPTG. In one embodiment, the chemical and/or nutritional inducer is rhamnose and the promoter is inducible by rhamnose. In one embodiment, the chemical and/or nutritional inducer is tetracycline and the promoter is inducible by tetracycline.

In one embodiment, expression of one or more payload(s), is under the control of one or more promoter(s) regulated by chemical and/or nutritional inducers and is driven from the same promoter in the form of a multicistronic message under anaerobic and/or low oxygen conditions. In one embodiment, expression of one or more payload(s), is under the control of one or more promoter(s) regulated by chemical and/or nutritional inducers and is driven from the same promoter as two or more separate messages under anaerobic and/or low oxygen conditions. In one embodiment, expression of one or more payload(s), is under the control of one or more promoter(s) regulated by chemical and/or nutritional inducers and is driven from the one or more different promoters under anaerobic and/or low oxygen conditions.

In one embodiment, strains may comprise a combination of gene sequence(s), some of which are under control of a first inducible promoter and others which are under control of a second inducible promoter, both induced by chemical and/or nutritional inducers, under anaerobic or low oxygen conditions. In one embodiment, strains may comprise a combination of gene sequence(s), some of which are under control of a first inducible promoter and others which are under control of a second inducible promoter, both induced by chemical and/or nutritional inducers. In some embodiments, the strains comprise gene sequence(s) under the control of a a third inducible promoter, e.g., an anaerobic/low oxygen promoter, e.g., FNR promoter. In one embodiment, strains may comprise a combination of gene sequence(s), some of which are under control of a first inducible promoter, e.g., a chemically induced promoter or a low oxygen promoter and others which are under control of a second inducible promoter, e.g. a temperature sensitive promoter. In one embodiment, strains may comprise a combination of gene sequence(s), some of which are under control of a first inducible promoter, e.g., a FNR promoter and others which are under control of a second inducible promoter, e.g. a temperature sensitive promoter. In one embodiment, strains may comprise a combination of gene sequence(s), some of which are under control of a first inducible promoter, e.g., a chemically induced and others which are under control of a second inducible promoter, e.g. a temperature sensitive promoter. In some embodiments, strains may comprise one or more payload gene sequence(s) and/or transporter gene sequence(s) and/or transcriptional regulator gene sequence(s) under the control of an FNR promoter and one or more payload gene sequence(s) and/or transporter gene sequence(s) and/or transcriptional regulator gene sequence(s) under the control of a one or more promoter(s) which are induced by a one or more chemical and/or nutritional inducer(s), including, but not limited to, by arabinose, IPTG, rhamnose, tetracycline, and/or other chemical and/or nutritional inducers described herein or known in the art. Additionally the strains may comprise a construct which is under thermoregulatory control. In some embodiments, the bacteria strains further comprise payload and or transporter sequence(s) under the control of one or more constitutive promoter(s) active under low oxygen conditions.

Aerobic Induction

In some embodiments, it is desirable to prepare, pre-load and pre-induce the strains under aerobic conditions. This allows more efficient growth and viability, and, in some cases, reduces the build-up of toxic metabolites. In such instances, cells are grown (e.g., for 1.5 to 3 hours) until they have reached a certain OD, e.g., ODs within the range of 0.1 to 10, indicating a certain density e.g., ranging from $1 \times 10^8$ to $1 \times 10^{11}$, and exponential growth and are then induced through the addition of the inducer or through other means, such as shift to a permissive temperature, for approximately 3 to 5 hours.

In some embodiments, promoters inducible by arabinose, IPTG, rhamnose, tetracycline, and/or other chemical and/or nutritional inducers described herein or known in the art can be induced under aerobic conditions in the presence of the chemical and/or nutritional inducer during cell growth, cell expansion, fermentation, recovery, purification, formulation, and/or manufacture. In one embodiment, expression of one or more payload(s) is under the control of one or more promoter(s) regulated by chemical and/or nutritional inducers and is induced during cell growth, cell expansion, fermentation, recovery, purification, formulation, and/or manufacture under aerobic conditions.

In one embodiment, expression of one or more payload(s), is under the control of one or more promoter(s) regulated by chemical and/or nutritional inducers and is driven from the same promoter in the form of a multicistronic message under aerobic conditions. In one embodiment, expression of one or more payload(s), is under the control of one or more promoter(s) regulated by chemical and/or nutritional inducers and is driven from the same promoter as two or more separate messages under aerobic conditions. In one embodiment, expression of one or more payload(s), is under the control of one or more promoter(s) regulated by chemical and/or nutritional inducers and is driven from the one or more different promoters under aerobic conditions.

In one embodiment, the chemical and/or nutritional inducer is arabinose and the promoter is inducible by arabinose. In one embodiment, the chemical and/or nutritional inducer is IPTG and the promoter is inducible by IPTG. In one embodiment, the chemical and/or nutritional inducer is rhamnose and the promoter is inducible by rhamnose. In one embodiment, the chemical and/or nutritional inducer is tetracycline and the promoter is inducible by tetracycline.

In some embodiments, promoters regulated by temperature are induced during cell growth, cell expansion, fermentation, recovery, purification, formulation, and/or manufacture. In one embodiment, expression of one or more payload(s) is driven directly or indirectly by one or more thermoregulated promoter(s) and is induced during cell growth, cell expansion, fermentation, recovery, purification, formulation, and/or manufacture under aerobic conditions.

In one embodiment, expression of one or more payload(s) is driven directly or indirectly by one or more thermoregulated promoter(s) and is driven from the same promoter in the form of a multicistronic message under aerobic conditions. In one embodiment, expression of one or more payload(s) is driven directly or indirectly by one or more thermoregulated promoter(s) and is driven from the same promoter as two or more separate messages under aerobic conditions. In one embodiment, expression of one or more payload(s) is driven directly or indirectly by one or more thermoregulated promoter(s) and is driven from the one or more different promoters under aerobic conditions.

In one embodiment, strains may comprise a combination of gene sequence(s), some of which are under control of a first inducible promoter and others which are under control of a second inducible promoter, both induced under aerobic conditions. In some embodiments, a strain comprises three or more different promoters which are induced under aerobic culture conditions.

In one embodiment, strains may comprise a combination of gene sequence(s), some of which are under control of a first inducible promoter and others which are under control of a second inducible promoter, both induced by chemical and/or nutritional inducers. In one embodiment, strains may comprise a combination of gene sequence(s), some of which are under control of a first inducible promoter, e.g. a chemically inducible promoter, and others which are under control of a second inducible promoter, e.g. a temperature sensitive promoter under aerobic culture conditions. In some embodiments two or more chemically induced promoter gene sequence(s) are combined with a thermoregulated construct described herein. In one embodiment, the chemical and/or nutritional inducer is arabinose and the promoter is inducible by arabinose. In one embodiment, the chemical and/or nutritional inducer is IPTG and the promoter is inducible by IPTG. In one embodiment, the chemical and/or nutritional inducer is rhamnose and the promoter is inducible by rhamnose. In one embodiment, the chemical and/or nutritional inducer is tetracycline and the promoter is inducible by tetracycline.

In one embodiment, strains may comprise a combination of gene sequence(s), some of which are under control of a first inducible promoter, e.g., a FNR promoter and others which are under control of a second inducible promoter, e.g. a temperature sensitive promoter. In one embodiment, strains may comprise a combination of gene sequence(s), some of which are under control of a first inducible promoter, e.g., a chemically induced and others which are under control of a second inducible promoter, e.g. a temperature sensitive promoter. In some embodiments, strains may comprise one or more payload gene sequence(s) and/or transporter gene sequence(s) and/or transcriptional regulator gene sequence(s) under the control of an FNR promoter and one or more payload gene sequence(s) and/or transporter gene sequence(s) and/or transcriptional regulator gene sequence(s) under the control of a one or more promoter(s) which are induced by a one or more chemical and/or nutritional inducer(s), including, but not limited to, by arabinose, IPTG, rhamnose, tetracycline, and/or other chemical and/or nutritional inducers described herein or known in the art. Additionally the strains may comprise a construct which is under thermoregulatory control. In some embodiments, the bacteria strains further comprise payload and or transporter sequence(s) under the control of one or more constitutive promoter(s) active under aerobic conditions.

In some embodiments, genetically engineered strains comprise gene sequence(s) which are induced under aerobic culture conditions. In some embodiments, these strains further comprise FNR inducible gene sequence(s) for in vivo activation in the gut and/or conditions of the tumor microenvironment. In some embodiments, these strains do not further comprise FNR inducible gene sequence(s) for in vivo activation in the gut and/or conditions of the tumor microenvironment.

In some embodiments, genetically engineered strains comprise gene sequence(s), which are arabinose inducible under aerobic culture conditions. In some embodiments, these strains do not further comprise FNR inducible gene sequence(s) for in vivo activation in the gut and/or conditions of the tumor microenvironment.

In some embodiments, genetically engineered strains comprise gene sequence(s), which are IPTG inducible under aerobic culture conditions. In some embodiments, these strains further comprise FNR inducible gene sequence(s) for in vivo activation in the gut and/or conditions of the tumor microenvironment. In some embodiments, these strains do not further comprise FNR inducible gene sequence(s) for in vivo activation in the gut and/or conditions of the tumor microenvironment.

In some embodiments, genetically engineered strains comprise gene sequence(s) which are arabinose inducible under aerobic culture conditions. In some embodiments, such a strain further comprises sequence(s) which are IPTG inducible under aerobic culture conditions. In some embodiments, these strains further comprise FNR inducible gene payload and/or transporter sequence(s) for in vivo activation in the gut. In some embodiments, these strains do not further comprise FNR inducible gene sequence(s) for in vivo activation in the gut and/or conditions of the tumor microenvironment.

As evident from the above non-limiting examples, genetically engineered strains comprise inducible gene sequence(s) which can be induced numerous combinations. For example, rhamnose or tetracycline can be used as an inducer with the appropriate promoters in addition or in lieu of arabinose and/or IPTG or with thermoregulation. Additionally, such bacterial strains can also be induced with the chemical and/or nutritional inducers under anaerobic conditions.

Microaerobic Induction

In some embodiments, viability, growth, and activity are optimized by pre-inducing the bacterial strain under microaerobic conditions. In some embodiments, microaerobic conditions are best suited to "strike a balance" between optimal growth, activity and viability conditions and optimal conditions for induction; in particular, if the expression of the one or more payload(s) and/or transporter(s) are driven by a anaerobic and/or low oxygen promoter, e.g., a FNR promoter. In such instances, cells are grown (e.g., for 1.5 to 3 hours) until they have reached a certain OD, e.g., ODs within the range of 0.1 to 10, indicating a certain density e.g., ranging from $1 \times 10^8$ to $1 \times 10^{11}$, and exponential growth and are then induced through the addition of the inducer or through other means, such as shift to at a permissive temperature, for approximately 3 to 5 hours.

In one embodiment, expression of one or more payload(s) is under the control of one or more FNR promoter(s) and is induced during cell growth, cell expansion, fermentation, recovery, purification, formulation, and/or manufacture under microaerobic conditions.

In one embodiment, expression of one or more payload(s), is under the control of one or more FNR promoter(s) and is driven from the same promoter in the form of a multicistronic message under microaerobic conditions. In one embodiment, expression of one or more payload(s), is under the control of one or more FNR promoter(s) and is driven from the same promoter as two or more separate messages under microaerobic conditions. In one embodiment, expression of one or more payload(s), is under the control of one or more FNR promoter(s) and is driven from the one or more different promoters under microaerobic conditions.

Without wishing to be bound by theory, strains that comprise one or more payload(s) under the control of an FNR promoter, may allow expression of payload(s) from these promoters in vitro, under microaerobic culture conditions, and in vivo, under the low oxygen conditions found in the gut and/or conditions of the tumor microenvironment.

In some embodiments, promoters inducible by arabinose, IPTG, rhamnose, tetracycline, and/or other chemical and/or nutritional inducers can be induced under microaerobic conditions in the presence of the chemical and/or nutritional inducer. In particular, strains may comprise a combination of gene sequence(s), some of which are under control of FNR promoters and others which are under control of promoters induced by chemical and/or nutritional inducers. In some embodiments, strains may comprise one or more payload gene sequence(s) sequence(s) under the control of one or more FNR promoter(s) and one or more payload gene sequence(s) under the control of a one or more promoter(s) which are induced by a one or more chemical and/or nutritional inducer(s), including, but not limited to, arabinose, IPTG, rhamnose, tetracycline, and/or other chemical and/or nutritional inducers described herein or known in the art. In some embodiments, strains may comprise one or more payload gene sequence(s) under the control of one or more FNR promoter(s), and one or more payload gene sequence(s) under the control of a one or more constitutive promoter(s) described herein. In some embodiments, strains may comprise one or more payload gene sequence(s) under the control of an FNR promoter and one or more payload gene sequence(s) under the control of a one or more thermoregulated promoter(s) described herein.

In one embodiment, expression of one or more payload(s) is under the control of one or more promoter(s) regulated by chemical and/or nutritional inducers and is induced during cell growth, cell expansion, fermentation, recovery, purification, formulation, and/or manufacture under microaerobic conditions.

In one embodiment, expression of one or more payload(s), is under the control of one or more promoter(s) regulated by chemical and/or nutritional inducers and is driven from the same promoter in the form of a multicistronic message under microaerobic conditions. In one embodiment, expression of one or more payload(s), is under the control of one or more promoter(s) regulated by chemical and/or nutritional inducers and is driven from the same promoter as two or more separate messages under microaerobic conditions. In one embodiment, expression of one or more payload(s), is under the control of one or more promoter(s) regulated by chemical and/or nutritional inducers and is driven from the one or more different promoters under microaerobic conditions.

In one embodiment, strains may comprise a combination of gene sequence(s), some of which are under control of a first inducible promoter and others which are under control of a second inducible promoter, both induced by chemical and/or nutritional inducers, under microaerobic conditions. In one embodiment, strains may comprise a combination of gene sequence(s), some of which are under control of a first inducible promoter and others which are under control of a second inducible promoter, both induced by chemical and/or nutritional inducers. In some embodiments, the strains comprise gene sequence(s) under the control of a third inducible promoter, e.g., an anaerobic/low oxygen promoter or microaerobic promoter, e.g., FNR promoter. In one embodiment, strains may comprise a combination of gene sequence(s), some of which are under control of a first inducible promoter, e.g., a chemically induced promoter or a low oxygen or microaerobic promoter and others which are under control of a second inducible promoter, e.g. a temperature sensitive promoter. In one embodiment, strains may comprise a combination of gene sequence(s), some of which are under control of a first inducible promoter, e.g., a FNR promoter and others which are under control of a second inducible promoter, e.g. a temperature sensitive promoter. In one embodiment, strains may comprise a combination of gene sequence(s), some of which are under control of a first inducible promoter, e.g., a chemically induced and others which are under control of a second inducible promoter, e.g. a temperature sensitive promoter. In some embodiments, strains may comprise one or more payload gene sequence(s) under the control of an FNR promoter and one or more payload gene sequence(s) under the control of a one or more promoter(s) which are induced by a one or more chemical and/or nutritional inducer(s), including, but not limited to, by arabinose, IPTG, rhamnose, tetracycline, and/or other chemical and/or nutritional inducers described herein or known in the art. Additionally the strains may comprise a construct which is under thermoregulatory control. In some embodiments, the bacteria strains further comprise payload under the control of one or more constitutive promoter(s) active under low oxygen conditions.

Induction of Strains Using Phasing, Pulsing and/or Cycling

In some embodiments, cycling, phasing, or pulsing techniques are employed during cell growth, expansion, recovery, purification, fermentation, and/or manufacture to efficiently induce and grow the strains prior to in vivo administration. This method is used to "strike a balance" between optimal growth, activity, cell health, and viability conditions and optimal conditions for induction; in particular, if growth, cell health or viability are negatively affected under inducing conditions. In such instances, cells are grown (e.g., for 1.5 to 3 hours) in a first phase or cycle until they have reached a certain OD, e.g., ODs within the range of 0.1 to 10, indicating a certain density e.g., ranging from $1\times10^8$ to $1\times10^{11}$, and are then induced through the addition of the inducer or through other means, such as shift to a permissive temperature (if a promoter is thermoregulated), or change in oxygen levels (e.g., reduction of oxygen level in the case of induction of an FNR promoter driven construct) for approximately 3 to 5 hours. In a second phase or cycle, conditions are brought back to the original conditions which support optimal growth, cell health and viability. Alternatively, if a chemical and/or nutritional inducer is used, then the culture can be spiked with a second dose of the inducer in the second phase or cycle.

In some embodiments, two cycles of optimal conditions and inducing conditions are employed (i.e, growth, induction, recovery and growth, induction). In some embodiments, three cycles of optimal conditions and inducing conditions are employed. In some embodiments, four or more cycles of optimal conditions and inducing conditions are employed. In a non-liming example, such cycling and/or phasing is used for induction under anaerobic and/or low oxygen conditions (e.g., induction of FNR promoters). In one embodiment, cells are grown to the optimal density and then induced under anaerobic and/or low oxygen conditions. Before growth and/or viability are negatively impacted due to stressful induction conditions, cells are returned to oxygenated conditions to recover, after which they are then returned to inducing anaerobic and/or low oxygen conditions for a second time. In some embodiments, these cycles are repeated as needed.

In some embodiments, growing cultures are spiked once with the chemical and/or nutritional inducer. In some embodiments, growing cultures are spiked twice with the chemical and/or nutritional inducer. In some embodiments, growing cultures are spiked three or more times with the chemical and/or nutritional inducer. In a non-limiting example, cells are first grown under optimal growth conditions up to a certain density, e.g., for 1.5 to 3 hour) to reached an of 0.1 to 10, until the cells are at a density ranging from $1\times10^8$ to $1\times10^{11}$. Then the chemical inducer, e.g., arabinose or IPTG, is added to the culture. After 3 to 5 hours, an additional dose of the inducer is added to re-initiate the induction. Spiking can be repeated as needed.

In some embodiments, phasing or cycling changes in temperature in the culture. In another embodiment, adjustment of temperature may be used to improve the activity of a payload. For example, lowering the temperature during culture may improve the proper folding of the payload. In such instances, cells are first grown at a temperature optimal for growth (e.g., 37 C). In some embodiments, the cells are then induced, e.g., by a chemical inducer, to express the payload. Concurrently or after a set amount of induction time, the temperature in the media is lowered, e.g., between 25 and 35 C, to allow improved folding of the expressed payload.

In some embodiments, payload(s) are under the control of different inducible promoters, for example two different chemical inducers. In other embodiments, the payload is induced under low oxygen conditions or microaerobic conditions and a second payload is induced by a chemical inducer.

In one embodiment, expression of one or more payload(s) is under the control of one or more FNR promoter(s) and is induced during cell growth, cell expansion, fermentation, recovery, purification, formulation, and/or manufacture by using phasing or cycling or pulsing or spiking techniques.

In one embodiment, expression of one or more payload(s), is under the control of one or more FNR promoter(s) and is driven from the same promoter in the form of a multicistronic message through the employment of phasing or cycling or pulsing or spiking techniques. In one embodiment, expression of one or more payload(s), is under the control of one or more FNR promoter(s) and is driven from the same promoter as two or more separate messages through the employment of phasing or cycling or pulsing or spiking techniques. In one embodiment, expression of one or more payload(s), is under the control of one or more FNR promoter(s) and is driven from the one or more different promoters through the employment of phasing or cycling or pulsing or spiking techniques.

In some embodiments, promoters inducible by arabinose, IPTG, rhamnose, tetracycline, and/or other chemical and/or nutritional inducers can be induced through the employment of phasing or cycling or pulsing or spiking techniques in the presence of the chemical and/or nutritional inducer. In particular, strains may comprise a combination of gene sequence(s), some of which are under control of FNR promoters and others which are under control of promoters induced by chemical and/or nutritional inducers. In some embodiments, strains may comprise one or more payload gene sequence(s) under the control of one or more FNR promoter(s) and one or more payload gene sequence(s) under the control of a one or more promoter(s) which are induced by a one or more chemical and/or nutritional inducer(s), including, but not limited to, arabinose, IPTG, rhamnose, tetracycline, and/or other chemical and/or nutritional inducers described herein or known in the art. In some embodiments, strains may comprise one or more payload gene sequence(s) under the control of one or more FNR promoter(s), and one or more payload gene sequence(s) and/or transporter gene sequence(s) and/or transcriptional regulator gene sequence(s) under the control of a one or more constitutive promoter(s) described herein and are induced through the employment of phasing or cycling or pulsing or spiking techniques. In some embodiments, strains may comprise one or more payload gene sequence(s) under the control of an FNR promoter and one or more payload gene sequence(s) under the control of a one or more thermoregulated promoter(s) described herein, and are induced through the employment of phasing or cycling or pulsing or spiking techniques.

Any of the strains described herein can be grown through the employment of phasing or cycling or pulsing or spiking techniques. In one embodiment, expression of one or more payload(s) is under the control of one or more promoter(s) regulated by chemical and/or nutritional inducers and is induced during cell growth, cell expansion, fermentation, recovery, purification, formulation, and/or manufacture under anaerobic and/or low oxygen conditions.

In one embodiment, expression of one or more payload(s), is under the control of one or more promoter(s) regulated by chemical and/or nutritional inducers and is driven from the same promoter in the form of a multicistronic message and which are induced through the employment of phasing or cycling or pulsing or spiking techniques. In one embodiment, expression of one or more payload(s), is under the control of one or more promoter(s) regulated by chemical and/or nutritional inducers and is driven from the same promoter as two or more separate messages and is grown through the employment of phasing or cycling or pulsing or spiking techniques. In one embodiment, expression of one or more payload(s), is under the control of one or more promoter(s) regulated by chemical and/or nutritional inducers and is driven from the one or more different promoters, all of which are induced through the employment of phasing or cycling or pulsing or spiking techniques.

In one embodiment, strains may comprise a combination of gene sequence(s), some of which are under control of a first inducible promoter and others which are under control of a second inducible promoter, both induced by chemical and/or nutritional inducers, through the employment of phasing or cycling or pulsing or spiking techniques. In one embodiment, strains may comprise a combination of gene sequence(s), some of which are under control of a first inducible promoter and others which are under control of a second inducible promoter, both induced by chemical and/or nutritional inducers through the employment of phasing or cycling or pulsing or spiking techniques. In some embodiments, the strains comprise gene sequence(s) under the control of a a third inducible promoter, e.g., an anaerobic/low oxygen promoter, e.g., FNR promoter. In one embodiment, strains may comprise a combination of gene sequence(s), some of which are under control of a first inducible promoter, e.g., a chemically induced promoter or a low oxygen promoter and others which are under control of a second inducible promoter, e.g. a temperature sensitive promoter. In one embodiment, strains may comprise a combination of gene sequence(s), some of which are under control of a first inducible promoter, e.g., a FNR promoter and others which are under control of a second inducible promoter, e.g. a temperature sensitive promoter. In one embodiment, strains may comprise a combination of gene sequence(s), some of which are under control of a first inducible promoter, e.g., a chemically induced and others which are under control of a second inducible promoter, e.g. a temperature sensitive promoter. In some embodiments, strains may comprise one or more payload gene sequence(s) under the control of an FNR promoter and one or more payload gene sequence(s) under the control of a one or more promoter(s) which are induced by a one or more chemical and/or nutritional inducer(s), including, but not limited to, by arabinose, IPTG, rhamnose, tetracycline, and/or other chemical and/or nutritional inducers described herein or known in the art. Additionally the strains may comprise a construct which is under thermoregulatory control. In some embodiments, the bacteria strains further comprise payload sequence(s) under the control of one or more constitutive promoter(s) active under low oxygen conditions. Any of the strains described in these embodiments may be induced through the employment of phasing or cycling or pulsing or spiking techniques.

Aerobic Induction of the FNR Promoter

FNRS24Y is a mutated form of FNR which is more resistant to inactivation by oxygen, and therefore can activate FNR promoters under aerobic conditions (see e.g., Jervis A J The O2 sensitivity of the transcription factor FNR is controlled by Ser24 modulating the kinetics of [4Fe-4S] to [2Fe-2S] conversion, Proc Natl Acad Sci USA. 2009 Mar. 24; 106(12):4659-64, the contents of which is herein incorporated by reference in its entirety). In some embodiments, an oxygen bypass system shown and described in FIG. 85A is used. In this oxygen bypass system, FNRS24Y is induced by addition of arabinose and then drives the expression of the protein of interest (e.g., one or more anti-cancer effector(s) described herein) by binding and activating the FNR promoter under aerobic conditions. Thus, strains can be grown, produced or manufactured efficiently under aerobic conditions, while being effectively pre-induced and preloaded, as the system takes advantage of the strong FNR promoter resulting in of high levels of expression of the protein of interest. This system does not interfere with or compromise in vivo activation, since the mutated FNRS24Y is no longer expressed in the absence of arabinose, and wild type FNR then binds to the FNR promoter and drives expression of the protein of interest, e.g., one or more anti-cancer effector(s) described herein.

In some embodiments, FNRS24Y is expressed during aerobic culture growth and induces a gene of interest. In other embodiments described herein, a second payload expression can also be induced aerobically, e.g., by arabinose. In a non-limiting example, a protein of interest and FNRS24Y can in some embodiments be induced simultaneously, e.g., from an arabinose inducible promoter. In some embodiments, FNRS24Y and the protein of interest (e.g., one or more anti-cancer effector(s) described herein) are transcribed as a bicistronic message whose expression is driven by an arabinose promoter. In some embodiments, FNRS24Y is knocked into the arabinose operon, allowing expression to be driven from the endogenous Para promoter.

In some embodiments, a Lad promoter and IPTG induction are used in this system (in lieu of Para and arabinose induction). In some embodiments, a rhamnose inducible promoter is used in this system. In some embodiments, a temperature sensitive promoter is used to drive expression of FNRS24Y.

Generation of Bacterial Strains with Enhance Ability to Transport Biomolecules

Due to their ease of culture, short generation times, very high population densities and small genomes, microbes can be evolved to unique phenotypes in abbreviated timescales. Adaptive laboratory evolution (ALE) is the process of passaging microbes under selective pressure to evolve a strain with a preferred phenotype. Most commonly, this is applied to increase utilization of carbon/energy sources or adapting a strain to environmental stresses (e.g., temperature, pH), whereby mutant strains more capable of growth on the carbon substrate or under stress will outcompete the less adapted strains in the population and will eventually come to dominate the population.

This same process can be extended to any essential metabolite by creating an auxotroph. An auxotroph is a strain incapable of synthesizing an essential metabolite and must therefore have the metabolite provided in the media to grow. In this scenario, by making an auxotroph and passaging it on decreasing amounts of the metabolite, the resulting dominant strains should be more capable of obtaining and incorporating this essential metabolite.

For example, if the biosynthetic pathway for producing an amino acid is disrupted a strain capable of high-affinity capture of said amino acid can be evolved via ALE. First, the strain is grown in varying concentrations of the auxotrophic amino acid, until a minimum concentration to support growth is established. The strain is then passaged at that concentration, and diluted into lowering concentrations of the amino acid at regular intervals. Over time, cells that are most competitive for the amino acid—at growth-limiting concentrations—will come to dominate the population. These strains will likely have mutations in their amino acid-transporters resulting in increased ability to import the essential and limiting amino acid.

Similarly, by using an auxotroph that cannot use an upstream metabolite to form an amino acid, a strain can be evolved that not only can more efficiently import the upstream metabolite, but also convert the metabolite into the essential downstream metabolite. These strains will also evolve mutations to increase import of the upstream metabolite, but may also contain mutations which increase expression or reaction kinetics of downstream enzymes, or that reduce competitive substrate utilization pathways.

In the previous examples, a metabolite innate to the microbe was made essential via mutational auxotrophy and selection was applied with growth-limiting supplementation of the endogenous metabolite. However, phenotypes capable of consuming non-native compounds can be evolved by tying their consumption to the production of an essential compound. For example, if a gene from a different organism is isolated which can produce an essential compound or a precursor to an essential compound this gene can be recombinantly introduced and expressed in the heterologous host. This new host strain will now have the ability to synthesize an essential nutrient from a previously non-metabolizable substrate. Hereby, a similar ALE process can be applied by creating an auxotroph incapable of converting an immediately downstream metabolite and selecting in growth-limiting amounts of the non-native compound with concurrent expression of the recombinant enzyme. This will result in mutations in the transport of the non-native substrate, expression and activity of the heterologous enzyme and expression and activity of downstream native enzymes. It should be emphasized that the key requirement in this process is the ability to tether the consumption of the non-native metabolite to the production of a metabolite essential to growth.

Once the basis of the selection mechanism is established and minimum levels of supplementation have been established, the actual ALE experimentation can proceed. Throughout this process several parameters must be vigilantly monitored. It is important that the cultures are maintained in an exponential growth phase and not allowed to reach saturation/stationary phase. This means that growth rates must be check during each passaging and subsequent dilutions adjusted accordingly. If growth rate improves to such a degree that dilutions become large, then the concentration of auxotrophic supplementation should be decreased such that growth rate is slowed, selection pressure is increased and dilutions are not so severe as to heavily bias subpopulations during passaging. In addition, at regular intervals cells should be diluted, grown on solid media and individual clones tested to confirm growth rate phenotypes observed in the ALE cultures.

Predicting when to halt the stop the ALE experiment also requires vigilance. As the success of directing evolution is tied directly to the number of mutations "screened" throughout the experiment and mutations are generally a function of errors during DNA replication, the cumulative cell divisions (CCD) acts as a proxy for total mutants which have been screened. Previous studies have shown that beneficial phenotypes for growth on different carbon sources can be isolated in about $10^{11.2}$ CCD[1]. This rate can be accelerated by the addition of chemical mutagens to the cultures—such as N-methyl-N-nitro-N-nitrosoguanidine (NTG)—which causes increased DNA replication errors. However, when continued passaging leads to marginal or no improvement in growth rate the population has converged to some fitness maximum and the ALE experiment can be halted.

At the conclusion of the ALE experiment, the cells should be diluted, isolated on solid media and assayed for growth phenotypes matching that of the culture flask. Best performers from those selected are then prepped for genomic DNA and sent for whole genome sequencing. Sequencing with reveal mutations occurring around the genome capable of providing improved phenotypes, but will also contain silent mutations (those which provide no benefit but do not detract from desired phenotype). In cultures evolved in the presence of NTG or other chemical mutagen, there will be significantly more silent, background mutations. If satisfied with the best performing strain in its current state, the user can proceed to application with that strain. Otherwise the contributing mutations can be deconvoluted from the evolved strain by reintroducing the mutations to the parent strain by genome engineering techniques. See Lee, D.-H., Feist, A. M., Barrett, C. L. & Palsson, B. Ø. Cumulative Number of Cell Divisions as a Meaningful Timescale for Adaptive Laboratory Evolution of *Escherichia coli*. PLoS ONE 6, e26172 (2011).

These methods were used to generate *E. coli* Nissle mutants that consume kynurenine and over-produce tryptophan as described elsewhere herein.

Nucleic Acids

In some embodiments, the nucleic acid comprises gene sequence encoding Add. In some embodiments, the nucleic acid comprises gene sequence encoding XapA. In some embodiments, the nucleic acid comprises gene sequence encoding DeoD. In some embodiments, the nucleic acid comprises gene sequence encoding XdhA. In some embodiments, the nucleic acid comprises gene sequence encoding XdhB. In some embodiments, the nucleic acid comprises gene sequence encoding XdhC. In some embodiments, the nucleic acid comprises gene sequence encoding NupC. In some embodiments, the nucleic acid comprises gene sequence encoding NupG.

In some embodiments, the nucleic acid comprises gene sequence selected from xapA, deoD, xdhA, xdhB, xdhC, nupC and any combinations thereof. In some embodiments, the nucleic acid comprises gene sequence selected from xapA, deoD, xdhA, xdhB, xdhC, nupG and any combinations thereof.

In some embodiments, the nucleic acid sequence comprising gene sequence selected from xapA, deoD, xdhA, xdhB, xdhC, nupC and any combinations thereof further comprises a nucleic acid sequence encoding antiCD40 antibody.

In some embodiments, the disclosure provides novel nucleic acids for degrading or depleting adenosine from the tumor microenvironment. In some embodiments, the nucleic acid comprises gene sequence encoding one or more adenosine catabolism enzyme(s). In one of the nucleic acid embodiments described herein, the nucleic acid sequence encoding the adenosine degrading enzyme comprises nupC. Accordingly, in one embodiment, the nucleic acid sequence comprising the nupC gene has at least about 80% identity with SEQ ID NO: 71. In one embodiment, the nucleic acid sequence comprising the nupC gene has at least about 90% identity with SEQ ID NO: 71. In another embodiment, the nucleic acid sequence comprising the nupC gene has at least about 95% identity with SEQ ID NO: 71. Accordingly, in one embodiment, the nucleic acid sequence comprising the nupC gene has at least about 85%, 86%, 87%, 88%, 89%, 90%, 91%, 92%, 93%, 94%, 95%, 96%, 97%, 98%, or 99% identity with SEQ ID NO: 71. In another embodiment, the nucleic acid sequence comprising the nupC gene comprises SEQ ID NO: 71. In yet another embodiment the nucleic acid sequence comprising the nupC gene consists of SEQ ID NO: 71.

In some embodiments, the disclosure provides novel nucleic acids for degrading or depleting adenosine from the tumor microenvironment. In some embodiments, the nucleic acid comprises gene sequence encoding one or more adenosine catabolism enzyme(s). In one of the nucleic acid embodiments described herein, the nucleic acid sequence encoding the adenosine degrading enzyme comprises xdhA. Accordingly, in one embodiment, the nucleic acid sequence comprising the xdhA gene has at least about 80% identity with SEQ ID NO: 72. In one embodiment, the nucleic acid sequence comprising the xdhA gene has at least about 90% identity with SEQ ID NO: 72. In another embodiment, the nucleic acid sequence comprising the xdhA gene has at least about 95% identity with SEQ ID NO: 72. Accordingly, in one embodiment, the nucleic acid sequence comprising the xdhA gene has at least about 85%, 86%, 87%, 88%, 89%, 90%, 91%, 92%, 93%, 94%, 95%, 96%, 97%, 98%, or 99% identity with SEQ ID NO: 72. In another embodiment, the nucleic acid sequence comprising the xdhA gene comprises SEQ ID NO: 72. In yet another embodiment the nucleic acid sequence comprising the xdhA gene consists of SEQ ID NO: 72.

In some embodiments, the disclosure provides novel nucleic acids for degrading or depleting adenosine from the tumor microenvironment. In some embodiments, the nucleic acid comprises gene sequence encoding one or more adenosine catabolism enzyme(s). In one of the nucleic acid embodiments described herein, the nucleic acid sequence encoding the adenosine degrading enzyme comprises xdhB. Accordingly, in one embodiment, the nucleic acid sequence comprising the xdhB gene has at least about 80% identity with SEQ ID NO: 73. In one embodiment, the nucleic acid sequence comprising the xdhB gene has at least about 90% identity with SEQ ID NO: 73. In another embodiment, the nucleic acid sequence comprising the xdhB gene has at least about 95% identity with SEQ ID NO: 73. Accordingly, in one embodiment, the nucleic acid sequence comprising the xdhB gene has at least about 85%, 86%, 87%, 88%, 89%, 90%, 91%, 92%, 93%, 94%, 95%, 96%, 97%, 98%, or 99% identity with SEQ ID NO: 73. In another embodiment, the nucleic acid sequence comprising the xdhB gene comprises SEQ ID NO: 73. In yet another embodiment the nucleic acid sequence comprising the xdhB gene consists of SEQ ID NO: 73.

In some embodiments, the disclosure provides novel nucleic acids for degrading or depleting adenosine from the tumor microenvironment. In some embodiments, the nucleic acid comprises gene sequence encoding one or more adenosine catabolism enzyme(s). In one of the nucleic acid embodiments described herein, the nucleic acid sequence encoding the adenosine degrading enzyme comprises xdhC. Accordingly, in one embodiment, the nucleic acid sequence comprising the xdhC gene has at least about 80% identity with SEQ ID NO: 74. In one embodiment, the nucleic acid sequence comprising the xdhC gene has at least about 90% identity with SEQ ID NO: 74. In another embodiment, the nucleic acid sequence comprising the xdhC gene has at least about 95% identity with SEQ ID NO: 74. Accordingly, in one embodiment, the nucleic acid sequence comprising the xdhC gene has at least about 85%, 86%, 87%, 88%, 89%, 90%, 91%, 92%, 93%, 94%, 95%, 96%, 97%, 98%, or 99% identity with SEQ ID NO: 74. In another embodiment, the nucleic acid sequence comprising the xdhC gene comprises SEQ ID NO: 74. In yet another embodiment the nucleic acid sequence comprising the xdhC gene consists of SEQ ID NO: 74.

In some embodiments, the disclosure provides novel nucleic acids for degrading or depleting adenosine from the tumor microenvironment. In some embodiments, the nucleic acid comprises gene sequence encoding one or more adenosine catabolism enzyme(s). In one of the nucleic acid embodiments described herein, the nucleic acid sequence encoding the adenosine degrading enzyme comprises Add. Accordingly, in one embodiment, the nucleic acid sequence comprising the Add gene has at least about 80% identity with SEQ ID NO: 75. In one embodiment, the nucleic acid sequence comprising the Add gene has at least about 90% identity with SEQ ID NO: 75. In another embodiment, the nucleic acid sequence comprising the Add gene has at least about 95% identity with SEQ ID NO: 75. Accordingly, in one embodiment, the nucleic acid sequence comprising the Add gene has at least about 85%, 86%, 87%, 88%, 89%, 90%, 91%, 92%, 93%, 94%, 95%, 96%, 97%, 98%, or 99% identity with SEQ ID NO: 75. In another embodiment, the nucleic acid sequence comprising the Add gene comprises SEQ ID NO: 75. In yet another embodiment the nucleic acid sequence comprising the Add gene consists of SEQ ID NO: 75.

In some embodiments, the disclosure provides novel nucleic acids for degrading or depleting adenosine from the tumor microenvironment. In some embodiments, the nucleic acid comprises gene sequence encoding one or more adenosine catabolism enzyme(s). In one of the nucleic acid embodiments described herein, the nucleic acid sequence encoding the adenosine degrading enzyme comprises xapA. Accordingly, in one embodiment, the nucleic acid sequence comprising the xapA gene has at least about 80% identity with SEQ ID NO: 76. In one embodiment, the nucleic acid sequence comprising the xapA gene has at least about 90% identity with SEQ ID NO: 76. In another embodiment, the nucleic acid sequence comprising the xapA gene has at least about 95% identity with SEQ ID NO: 76. Accordingly, in one embodiment, the nucleic acid sequence comprising the xapA gene has at least about 85%, 86%, 87%, 88%, 89%, 90%, 91%, 92%, 93%, 94%, 95%, 96%, 97%, 98%, or 99% identity with SEQ ID NO: 76. In another embodiment, the nucleic acid sequence comprising the xapA gene comprises SEQ ID NO: 76. In yet another embodiment the nucleic acid sequence comprising the xapA gene consists of SEQ ID NO: 76.

In some embodiments, the disclosure provides novel nucleic acids for degrading or depleting adenosine from the tumor microenvironment. In some embodiments, the nucleic acid comprises gene sequence encoding one or more adenosine catabolism enzyme(s). In one of the nucleic acid embodiments described herein, the nucleic acid sequence encoding the adenosine degrading enzyme comprises deoD. Accordingly, in one embodiment, the nucleic acid sequence comprising the deoD gene has at least about 80% identity with SEQ ID NO: 77. In one embodiment, the nucleic acid sequence comprising the deoD gene has at least about 90% identity with SEQ ID NO: 77. In another embodiment, the nucleic acid sequence comprising the deoD gene has at least about 95% identity with SEQ ID NO: 77. Accordingly, in one embodiment, the nucleic acid sequence comprising the deoD gene has at least about 85%, 86%, 87%, 88%, 89%, 90%, 91%, 92%, 93%, 94%, 95%, 96%, 97%, 98%, or 99% identity with SEQ ID NO: 77. In another embodiment, the nucleic acid sequence comprising the deoD gene comprises SEQ ID NO: 77. In yet another embodiment the nucleic acid sequence comprising the deoD gene consists of SEQ ID NO: 77.

In one of the nucleic acid embodiments described herein, the adenosine catabolism enzyme comprises NupC. In one embodiment, the nucleic acid sequence encodes a polypeptide, which has at least about 80% identity with SEQ ID NO: 78. In one embodiment, the nucleic acid sequence encodes a polypeptide, which has at least about 90% identity with SEQ ID NO: 78. In another embodiment, the nucleic acid sequence encodes a polypeptide, which has at least about 95% identity with SEQ ID NO: 78. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 78. In another embodiment, the nucleic acid sequence encodes a polypeptide, which comprises a sequence which encodes SEQ ID NO: 78. In yet another embodiment, the nucleic acid sequence encodes a polypeptide, which consists of a sequence which encodes SEQ ID NO: 78.

In one of the nucleic acid embodiments described herein, the adenosine catabolism enzyme comprises XdhA. In one embodiment, the nucleic acid sequence encodes a polypeptide, which has at least about 80% identity with SEQ ID NO: 79. In one embodiment, the nucleic acid sequence encodes a polypeptide, which has at least about 90% identity with SEQ ID NO: 79. In another embodiment, the nucleic acid sequence encodes a polypeptide, which has at least about 95% identity with SEQ ID NO: 79. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 79. In another embodiment, the nucleic acid sequence encodes a polypeptide, which comprises a sequence which encodes SEQ ID NO: 79. In yet another embodiment, the nucleic acid sequence encodes a polypeptide, which consists of a sequence which encodes SEQ ID NO: 79.

In one of the nucleic acid embodiments described herein, the adenosine catabolism enzyme comprises XdhB. In one embodiment, the nucleic acid sequence encodes a polypeptide, which has at least about 80% identity with SEQ ID NO: 80. In one embodiment, the nucleic acid sequence encodes a polypeptide, which has at least about 90% identity with SEQ ID NO: 80. In another embodiment, the nucleic acid sequence encodes a polypeptide, which has at least about 95% identity with SEQ ID NO: 80. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 80. In another embodiment, the nucleic acid sequence encodes a polypeptide, which comprises a sequence which encodes SEQ ID NO: 80. In yet another embodiment, the nucleic acid sequence encodes a polypeptide, which consists of a sequence which encodes SEQ ID NO: 80.

In one of the nucleic acid embodiments described herein, the adenosine catabolism enzyme comprises XdhC. In one embodiment, the nucleic acid sequence encodes a polypeptide, which has at least about 80% identity with SEQ ID NO: 81. In one embodiment, the nucleic acid sequence encodes a polypeptide, which has at least about 90% identity with SEQ ID NO: 81. In another embodiment, the nucleic acid sequence encodes a polypeptide, which has at least about 95% identity with SEQ ID NO: 81. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 81. In another embodiment, the nucleic acid sequence encodes a polypeptide, which comprises a sequence which encodes SEQ ID NO: 81. In yet another embodiment, the nucleic acid sequence encodes a polypeptide, which consists of a sequence which encodes SEQ ID NO: 81.

In one of the nucleic acid embodiments described herein, the adenosine catabolism enzyme comprises Add. In one embodiment, the nucleic acid sequence encodes a polypeptide, which has at least about 80% identity with SEQ ID NO: 82. In one embodiment, the nucleic acid sequence encodes a polypeptide, which has at least about 90% identity with SEQ ID NO: 82. In another embodiment, the nucleic acid sequence encodes a polypeptide, which has at least about 95% identity with SEQ ID NO: 82. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 82. In another embodiment, the nucleic acid sequence encodes a polypeptide, which comprises a sequence which encodes SEQ ID NO: 82. In yet another embodiment, the nucleic acid sequence encodes a polypeptide, which consists of a sequence which encodes SEQ ID NO: 82.

In one of the nucleic acid embodiments described herein, the adenosine catabolism enzyme comprises XapA. In one embodiment, the nucleic acid sequence encodes a polypeptide, which has at least about 80% identity with SEQ ID NO: 83. In one embodiment, the nucleic acid sequence encodes a polypeptide, which has at least about 90% identity with SEQ ID NO: 83. In another embodiment, the nucleic acid sequence encodes a polypeptide, which has at least about 95% identity with SEQ ID NO: 83. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 83. In another embodiment, the nucleic acid sequence encodes a polypeptide, which comprises a sequence which encodes SEQ ID NO: 83. In yet another embodiment, the nucleic acid sequence encodes a polypeptide, which consists of a sequence which encodes SEQ ID NO: 83.

In one of the nucleic acid embodiments described herein, the adenosine catabolism enzyme comprises DeoD. In one embodiment, the nucleic acid sequence encodes a polypeptide, which has at least about 80% identity with SEQ ID NO: 84. In one embodiment, the nucleic acid sequence encodes a polypeptide, which has at least about 90% identity with SEQ ID NO: 84. In another embodiment, the nucleic acid sequence encodes a polypeptide, which has at least about 95% identity with SEQ ID NO: 84. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 84. In another embodiment, the nucleic acid sequence encodes a polypeptide, which comprises a sequence which encodes SEQ ID NO: 84. In yet another embodiment, the nucleic acid sequence encodes a polypeptide, which consists of a sequence which encodes SEQ ID NO: 84.

In some embodiments, the disclosure provides novel nucleic acids for catabolizing adenosine. In some embodiments, the nucleic acid comprises gene sequence encoding one or more adenosine catabolism enzyme cassette(s). In one of the nucleic acid embodiments described herein, the nucleic acid sequence encoding the adenosine degrading enzyme cassette comprises a nucleic acid sequence comprising xdhABC. Accordingly, in one embodiment, nucleic acid sequence comprising xdhABC has at least about 80% identity with SEQ ID NO: 857. In one embodiment, the nucleic acid sequence comprising xdhABC has at least about 90% identity with SEQ ID NO: 857. In one embodiment, the nucleic acid sequence comprising xdhABC has at least about 95% identity with SEQ ID NO: 857. In one embodiment, the nucleic acid sequence comprising xdhABC has at least about 85%, 86%, 87%, 88%, 89%, 90%, 91%, 92%, 93%, 94%, 95%, 96%, 97%, 98%, or 99% identity with SEQ ID NO: 857. In another embodiment, the nucleic acid sequence comprising xdhABC comprises the sequence of SEQ ID NO: 857. In another embodiment, the nucleic acid sequence comprising xdhABC consists of the sequence of SEQ ID NO: 857.

In some embodiments, the disclosure provides novel nucleic acids for catabolizing adenosine. In some embodiments, the nucleic acid comprises gene sequence encoding one or more adenosine catabolism enzyme cassette(s). In one of the nucleic acid embodiments described herein, the nucleic acid sequence encoding the adenosine degrading enzyme cassette comprises a nucleic acid sequence comprising add-xapA-deoD. Accordingly, in one embodiment, nucleic acid sequence comprising add-xapA-deoD has at least about 80% identity with SEQ ID NO: 861. In one embodiment, the nucleic acid sequence comprising add-xapA-deoD has at least about 90% identity with SEQ ID NO: 861. In one embodiment, the nucleic acid sequence comprising add-xapA-deoD has at least about 95% identity with SEQ ID NO: 861. In one embodiment, the nucleic acid sequence comprising add-xapA-deoD has at least about 85%, 86%, 87%, 88%, 89%, 90%, 91%, 92%, 93%, 94%, 95%, 96%, 97%, 98%, or 99% identity with SEQ ID NO: 861. In another embodiment, the nucleic acid sequence comprising add-xapA-deoD comprises the sequence of SEQ ID NO: 861. In another embodiment, the nucleic acid sequence comprising add-xapA-deoD consists of the sequence of SEQ ID NO: 861.

In some embodiments, the nucleic acid comprises gene sequence encoding argA. In some embodiments, the nucleic acid comprises gene sequence encoding argB. In some embodiments the nucleic acid comprises gene sequence encoding argC. In some embodiments the nucleic acid comprises gene sequence encoding argD. In some embodiments, the nucleic acid comprises gene sequence encoding argE. In some embodiments, the nucleic acid comprises gene sequence encoding argF. In some embodiments the nucleic acid comprises gene sequence encoding argG. In some embodiments the nucleic acid comprises gene sequence encoding argH. In some embodiments, the nucleic acid comprises gene sequence encoding argI. In some embodiments, the nucleic acid comprises gene sequence encoding argJ. In some embodiments the nucleic acid comprises gene sequence encoding carA. In some embodiments the nucleic acid comprises gene sequence encoding carB. In some embodiments the nucleic acid comprises gene sequence encoding argA(fbr).

In some embodiments the nucleic acid comprises gene sequence encoding arginine biosynthesis genes selected from argA, argB, argC, argD, argE, argF, argG, argH, argI, argJ, carA, and carB and feedback resistant argA and any combinations thereof. In some embodiments the nucleic acid sequence comprising gene sequence encoding arginine biosynthesis genes selected from argA, argB, argC, argD, argE, argF, argG, argH, argI, argJ, carA, and carB and feedback resistant argA and any combinations thereof further comprises nucleic acid sequence encoding anti-CD47 antibody.

In some embodiments, the disclosure provides novel nucleic acids for producing arginine. In some embodiments, the nucleic acid comprises gene sequence encoding one or more arginine production polypeptides. In one of the nucleic acid embodiments described herein, the nucleic acid sequence encoding the arginine production enzyme comprises argA(fbr) (feedback resistant argA). Accordingly, in one embodiment, the nucleic acid sequence comprising the argA(fbr) gene has at least about 80% identity with SEQ ID NO: 102. In one embodiment, the nucleic acid sequence comprising the argA(fbr) gene has at least about 90% identity with SEQ ID NO: 102. In another embodiment, the nucleic acid sequence comprising the argA(fbr) gene has at least about 95% identity with SEQ ID NO: 102. Accordingly, in one embodiment, the nucleic acid sequence comprising the argA(fbr) gene has at least about 85%, 86%, 87%, 88%, 89%, 90%, 91%, 92%, 93%, 94%, 95%, 96%, 97%, 98%, or 99% identity with SEQ ID NO: 102. In another embodiment, the nucleic acid sequence comprising the argA(fbr) gene comprises SEQ ID NO: 102. In yet another embodiment the nucleic acid sequence comprising the argA(fbr) gene consists of SEQ ID NO: 102.

In one of the nucleic acid embodiments described herein, the arginine production enzyme comprises argA(fbr). In one embodiment, the nucleic acid sequence encodes a polypeptide, which has at least about 80% identity with SEQ ID NO: 103. In one embodiment, the nucleic acid sequence encodes a polypeptide, which has at least about 90% identity with SEQ ID NO: 103. In another embodiment, the nucleic acid sequence encodes a polypeptide, which has at least about 95% identity with SEQ ID NO: 103. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 103. In another embodiment, the nucleic acid sequence encodes a polypeptide, which comprises a sequence which encodes SEQ ID NO: 103. In yet another embodiment, the nucleic acid sequence encodes a polypeptide, which consists of a sequence which encodes SEQ ID NO: 103.

In some embodiments, the nucleic acid comprises gene sequence encoding TrpE. In some embodiments, the nucleic acid comprises gene sequence encoding TrpD. In some embodiments the nucleic acid comprises gene sequence encoding TrpC. In some embodiments the nucleic acid comprises gene sequence encoding TrpB. In some embodiments the nucleic acid comprises gene sequence encoding TrpA. In some embodiments, the nucleic acid comprises gene sequence encoding AroG. In some embodiments, the nucleic acid comprises gene sequence encoding AroF. In some embodiments, the nucleic acid comprises gene sequence encoding AroH. In some embodiments, the nucleic acid comprises gene sequence encoding AroB. In some embodiments, the nucleic acid comprises gene sequence encoding AroD. In some embodiments, the nucleic acid comprises gene sequence encoding AroE. In some embodiments, the nucleic acid comprises gene sequence encoding AroK. In some embodiments, the nucleic acid comprises gene sequence encoding AroA. In some embodiments, the nucleic acid comprises gene sequence encoding aroG(fbr). In some embodiments, the nucleic acid comprises gene sequence encoding trpE(fbr). In some embodiments, the nucleic acid comprises gene sequence encoding serA(fbr). In some embodiments, the nucleic acid comprises gene sequence encoding YddG. In some embodiments the nucleic acid comprises gene sequence encoding kynureninase. In some embodiments, the nucleic acid comprises gene sequence selected from TrpE, TrpD, TrpC, TrpB, and TrpA and any combinations thereof. In some embodiments, the nucleic acid comprises gene sequence selected from TrpE, TrpD, TrpC, TrpB, TrpA and kynureninase and any combinations thereof. In some embodiments, the nucleic acid comprises gene sequence selected from TrpE, TrpD, TrpC, TrpB, TrpA, AroG, AroF, AroH and any combinations thereof. In some embodiments, the nucleic acid comprises gene sequence selected from TrpE, TrpD, TrpC, TrpB, TrpA, AroG, AroF, AroH and kynureininase and any combinations thereof. In some embodiments, the nucleic acid comprises gene sequence selected from TrpE, TrpD, TrpC, TrpB, TrpA, AroG, AroF, AroH, AroB, AroD, AroE, AroK, and aroA and any combinations thereof. In some embodiments, the nucleic acid comprises gene sequence selected from TrpE, TrpD, TrpC, TrpB, TrpA, AroG, AroF, AroH, AroB, AroD, AroE, AroK, and aroA and kynureininase and any combinations thereof. In some embodiments, the nucleic acid comprises gene sequence selected from AroG(fbr), TrpE(fbr), TrpD, TrpC, TrpB, TrpA and any combinations thereof. In some embodiments, the nucleic acid comprises gene sequence selected from AroG(fbr), TrpE(fbr), TrpD, TrpC, TrpB, TrpA and kynureininase and any combinations thereof. In some embodiments, the nucleic acid comprises gene sequence selected from AroG(fbr), SerA(fbr), TrpE(fbr), TrpD, TrpC, TrpB, TrpA and any combinations thereof. In some embodiments, the nucleic acid comprises gene sequence selected from AroG(fbr), SerA(fbr), TrpE(fbr), TrpD, TrpC, TrpB, TrpA and kynureininase and any combinations thereof. In some embodiments, the nucleic acid comprises gene sequence selected from AroG(fbr), SerA(fbr), TrpE(fbr), TrpD, TrpC, TrpB, TrpA, YddG and any combinations thereof. In some embodiments, the nucleic acid comprises gene sequence selected from AroG(fbr), SerA(fbr), TrpE(fbr), TrpD, TrpC, TrpB, TrpA YddG and kynureininase and any combinations thereof.

In some embodiments the nucleic acid comprising gene sequence encoding kynureninase further comprised nucleic acid sequence comprising gene sequence encoding IL-15.

In some embodiments, the disclosure provides novel nucleic acids for secreting IL-15. In some embodiments, the nucleic acid comprises gene sequence encoding IL-15 for secretion. In one of the nucleic acid embodiments described herein, the nucleic acid sequence encoding IL-15 for secretion comprises PhoA-Il-15. Accordingly, in one embodiment, the nucleic acid sequence comprising the Il-15 gene has at least about 80% identity with SEQ ID NO: 957. In one embodiment, the nucleic acid sequence comprising the Il-15 gene has at least about 90% identity with SEQ ID NO: 957. In another embodiment, the nucleic acid sequence comprising the Il-15 gene has at least about 95% identity with SEQ ID NO: 957. Accordingly, in one embodiment, the nucleic acid sequence comprising the Il-15 gene has at least about 85%, 86%, 87%, 88%, 89%, 90%, 91%, 92%, 93%, 94%, 95%, 96%, 97%, 98%, or 99% identity with SEQ ID NO: 957. In another embodiment, the nucleic acid sequence comprising the Il-15 gene comprises SEQ ID NO: 957. In yet another embodiment the nucleic acid sequence comprising the Il-15 gene consists of SEQ ID NO: 957.

In one of the nucleic acid embodiments described herein, the nucleic acid encodes IL-15 (OmpF secretion tag). In one embodiment, the nucleic acid sequence encodes a polypeptide, which has at least about 80% identity with SEQ ID NO: 935. In one embodiment, the nucleic acid sequence encodes a polypeptide, which has at least about 90% identity with SEQ ID NO: 935. In another embodiment, the nucleic acid sequence encodes a polypeptide, which has at least about 95% identity with SEQ ID NO: 935. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 935. In another embodiment, the nucleic acid sequence encodes a polypeptide, which comprises a sequence which encodes SEQ ID NO: 935. In yet another embodiment, the nucleic acid sequence encodes a polypeptide, which consists of a sequence which encodes SEQ ID NO: 935.

In one of the nucleic acid embodiments described herein, the nucleic acid encodes IL-15 (PhoA secretion tag). In one embodiment, the nucleic acid sequence encodes a polypeptide, which has at least about 80% identity with SEQ ID NO: 936. In one embodiment, the nucleic acid sequence encodes a polypeptide, which has at least about 90% identity with SEQ ID NO: 936. In another embodiment, the nucleic acid sequence encodes a polypeptide, which has at least about 95% identity with SEQ ID NO: 936. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 936. In another embodiment, the nucleic acid sequence encodes a polypeptide, which comprises a sequence which encodes SEQ ID NO: 936. In yet another embodiment, the nucleic acid sequence encodes a polypeptide, which consists of a sequence which encodes SEQ ID NO: 936.

In one of the nucleic acid embodiments described herein, the nucleic acid encodes IL-15 (TorA secretion tag). In one embodiment, the nucleic acid sequence encodes a polypeptide, which has at least about 80% identity with SEQ ID NO: 937. In one embodiment, the nucleic acid sequence encodes a polypeptide, which has at least about 90% identity with SEQ ID NO: 937. In another embodiment, the nucleic acid sequence encodes a polypeptide, which has at least about 95% identity with SEQ ID NO: 937. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 937. In another embodiment, the nucleic acid sequence encodes a polypeptide, which comprises a sequence which encodes SEQ ID NO: 937. In yet another embodiment, the nucleic acid sequence encodes a polypeptide, which consists of a sequence which encodes SEQ ID NO: 937.

In some embodiments, the disclosure provides novel nucleic acids for depleting kynurenine. In some embodiments, the nucleic acid comprises gene sequence encoding one or more kynurenine depleting enzymes. In one of the nucleic acid embodiments described herein, the nucleic acid sequence encoding the kynurenine catabolism enzyme comprises kynU (Pseudomonas). Accordingly, in one embodiment, the nucleic acid sequence comprising the kynU gene has at least about 80% identity with SEQ ID NO: 68. In one embodiment, the nucleic acid sequence comprising the kynU gene has at least about 90% identity with SEQ ID NO: 68. In another embodiment, the nucleic acid sequence comprising the kynU gene has at least about 95% identity with SEQ ID NO: 68. Accordingly, in one embodiment, the nucleic acid sequence comprising the kynU gene has at least about 85%, 86%, 87%, 88%, 89%, 90%, 91%, 92%, 93%, 94%, 95%, 96%, 97%, 98%, or 99% identity with SEQ ID NO: 68. In another embodiment, the nucleic acid sequence comprising the kynU gene comprises SEQ ID NO: 68. In yet another embodiment the nucleic acid sequence comprising the kynU gene consists of SEQ ID NO: 68.

In some embodiments, the disclosure provides novel nucleic acids for depleting kynurenine. In some embodiments, the nucleic acid comprises gene sequence encoding one or more kynurenine depleting enzymes. In one of the nucleic acid embodiments described herein, the nucleic acid sequence encoding the kynurenine catabolism enzyme comprises kynU (Human). Accordingly, in one embodiment, the nucleic acid sequence comprising the kynU gene has at least about 80% identity with SEQ ID NO: 69. In one embodiment, the nucleic acid sequence comprising the kynU gene has at least about 90% identity with SEQ ID NO: 69. In another embodiment, the nucleic acid sequence comprising the kynU gene has at least about 95% identity with SEQ ID NO: 69. Accordingly, in one embodiment, the nucleic acid sequence comprising the kynU gene has at least about 85%, 86%, 87%, 88%, 89%, 90%, 91%, 92%, 93%, 94%, 95%, 96%, 97%, 98%, or 99% identity with SEQ ID NO: 69. In another embodiment, the nucleic acid sequence comprising the kynU gene comprises SEQ ID NO: 69. In yet another embodiment the nucleic acid sequence comprising the kynU gene consists of SEQ ID NO: 69.

In some embodiments, the disclosure provides novel nucleic acids for depleting kynurenine. In some embodiments, the nucleic acid comprises gene sequence encoding one or more kynurenine depleting enzymes. In one of the nucleic acid embodiments described herein, the nucleic acid sequence encoding the kynurenine catabolism enzyme comprises kynU (Shewanella). Accordingly, in one embodiment, the nucleic acid sequence comprising the kynU gene has at least about 80% identity with SEQ ID NO: 70. In one embodiment, the nucleic acid sequence comprising the kynU gene has at least about 90% identity with SEQ ID NO: 70. In another embodiment, the nucleic acid sequence comprising the kynU gene has at least about 95% identity with SEQ ID NO: 70. Accordingly, in one embodiment, the nucleic acid sequence comprising the kynU gene has at least about 85%, 86%, 87%, 88%, 89%, 90%, 91%, 92%, 93%, 94%, 95%, 96%, 97%, 98%, or 99% identity with SEQ ID NO: 70. In another embodiment, the nucleic acid sequence comprising the kynU gene comprises SEQ ID NO: 70. In yet another embodiment the nucleic acid sequence comprising the kynU gene consists of SEQ ID NO: 70.

In some embodiments, the disclosure provides novel nucleic acids for producing tryptophan. In some embodiments, the nucleic acid comprises gene sequence encoding one or more tryptophan production enzymes. In one of the nucleic acid embodiments described herein, the nucleic acid sequence encoding the kynurenine catabolism enzyme comprises trpE. Accordingly, in one embodiment, the nucleic acid sequence comprising the trpE gene has at least about 80% identity with SEQ ID NO: 50. In one embodiment, the nucleic acid sequence comprising the trpE gene has at least about 90% identity with SEQ ID NO: 50. In another embodiment, the nucleic acid sequence comprising the trpE gene has at least about 95% identity with SEQ ID NO: 50. Accordingly, in one embodiment, the nucleic acid sequence comprising the trpE gene has at least about 85%, 86%, 87%, 88%, 89%, 90%, 91%, 92%, 93%, 94%, 95%, 96%, 97%, 98%, or 99% identity with SEQ ID NO: 50. In another embodiment, the nucleic acid sequence comprising the trpE gene comprises SEQ ID NO: 50. In yet another embodiment the nucleic acid sequence comprising the trpE gene consists of SEQ ID NO: 50.

In some embodiments, the disclosure provides novel nucleic acids for producing tryptophan. In some embodiments, the nucleic acid comprises gene sequence encoding one or more tryptophan production enzyme(s). In one of the nucleic acid embodiments described herein, the nucleic acid sequence encoding the tryptophan producing enzyme comprises trpD. Accordingly, in one embodiment, the nucleic acid sequence comprising the trpD gene has at least about 80% identity with SEQ ID NO: 51. In one embodiment, the nucleic acid sequence comprising the trpD gene has at least about 90% identity with SEQ ID NO: 51. In another embodiment, the nucleic acid sequence comprising the trpD gene has at least about 95% identity with SEQ ID NO: 51. Accordingly, in one embodiment, the nucleic acid sequence comprising the trpD gene has at least about 85%, 86%, 87%, 88%, 89%, 90%, 91%, 92%, 93%, 94%, 95%, 96%, 97%, 98%, or 99% identity with SEQ ID NO: 51. In another embodiment, the nucleic acid sequence comprising the trpD gene comprises SEQ ID NO: 51. In yet another embodiment the nucleic acid sequence comprising the trpD gene consists of SEQ ID NO: 51.

In some embodiments, the disclosure provides novel nucleic acids for producing tryptophan. In some embodiments, the nucleic acid comprises gene sequence encoding one or more tryptophan production enzyme(s). In one of the nucleic acid embodiments described herein, the nucleic acid sequence encoding the tryptophan producing enzyme comprises trpC. Accordingly, in one embodiment, the nucleic acid sequence comprising the trpC gene has at least about 80% identity with SEQ ID NO: 52. In one embodiment, the nucleic acid sequence comprising the trpC gene has at least about 90% identity with SEQ ID NO: 52. In another embodiment, the nucleic acid sequence comprising the trpC gene has at least about 95% identity with SEQ ID NO: 52. Accordingly, in one embodiment, the nucleic acid sequence comprising the trpC gene has at least about 85%, 86%, 87%, 88%, 89%, 90%, 91%, 92%, 93%, 94%, 95%, 96%, 97%, 98%, or 99% identity with SEQ ID NO: 52. In another embodiment, the nucleic acid sequence comprising the trpC gene comprises SEQ ID NO: 52. In yet another embodiment the nucleic acid sequence comprising the trpC gene consists of SEQ ID NO: 52.

In some embodiments, the disclosure provides novel nucleic acids for producing tryptophan. In some embodiments, the nucleic acid comprises gene sequence encoding one or more tryptophan production enzyme(s). In one of the nucleic acid embodiments described herein, the nucleic acid sequence encoding the tryptophan producing enzyme comprises trpB. Accordingly, in one embodiment, the nucleic acid sequence comprising the trpB gene has at least about 80% identity with SEQ ID NO: 53. In one embodiment, the nucleic acid sequence comprising the trpB gene has at least about 90% identity with SEQ ID NO: 53. In another embodiment, the nucleic acid sequence comprising the trpB gene has at least about 95% identity with SEQ ID NO: 53. Accordingly, in one embodiment, the nucleic acid sequence comprising the trpB gene has at least about 85%, 86%, 87%, 88%, 89%, 90%, 91%, 92%, 93%, 94%, 95%, 96%, 97%, 98%, or 99% identity with SEQ ID NO: 53. In another embodiment, the nucleic acid sequence comprising the trpB gene comprises SEQ ID NO: 53. In yet another embodiment the nucleic acid sequence comprising the trpB gene consists of SEQ ID NO: 53.

In some embodiments, the disclosure provides novel nucleic acids for producing tryptophan. In some embodiments, the nucleic acid comprises gene sequence encoding one or more tryptophan production enzyme(s). In one of the nucleic acid embodiments described herein, the nucleic acid sequence encoding the tryptophan producing enzyme comprises trpA. Accordingly, in one embodiment, the nucleic acid sequence comprising the trpA gene has at least about 80% identity with SEQ ID NO: 54. In one embodiment, the nucleic acid sequence comprising the trpA gene has at least about 90% identity with SEQ ID NO: 54. In another embodiment, the nucleic acid sequence comprising the trpA gene has at least about 95% identity with SEQ ID NO: 54. Accordingly, in one embodiment, the nucleic acid sequence comprising the trpA gene has at least about 85%, 86%, 87%, 88%, 89%, 90%, 91%, 92%, 93%, 94%, 95%, 96%, 97%, 98%, or 99% identity with SEQ ID NO: 54. In another embodiment, the nucleic acid sequence comprising the trpA gene comprises SEQ ID NO: 54. In yet another embodiment the nucleic acid sequence comprising the trpA gene consists of SEQ ID NO: 54.

In some embodiments, the disclosure provides novel nucleic acids for producing tryptophan. In some embodiments, the nucleic acid comprises gene sequence encoding one or more tryptophan production enzyme(s). In one of the nucleic acid embodiments described herein, the nucleic acid sequence encoding the tryptophan producing enzyme comprises aroG(fbr). Accordingly, in one embodiment, the nucleic acid sequence comprising the aroG(fbr) gene has at least about 80% identity with SEQ ID NO: 862. In one embodiment, the nucleic acid sequence comprising the aroG(fbr) gene has at least about 90% identity with SEQ ID NO: 862. In another embodiment, the nucleic acid sequence comprising the aroG(fbr) gene has at least about 95% identity with SEQ ID NO: 862. Accordingly, in one embodiment, the nucleic acid sequence comprising the aroG(fbr) gene has at least about 85%, 86%, 87%, 88%, 89%, 90%, 91%, 92%, 93%, 94%, 95%, 96%, 97%, 98%, or 99% identity with SEQ ID NO: 862. In another embodiment, the nucleic acid sequence comprising the aroG(fbr) gene comprises SEQ ID NO: 862. In yet another embodiment the nucleic acid sequence comprising the aroG(fbr) gene consists of SEQ ID NO: 862.

In some embodiments, the disclosure provides novel nucleic acids for producing tryptophan. In some embodiments, the nucleic acid comprises gene sequence encoding one or more tryptophan production enzyme(s). In one of the nucleic acid embodiments described herein, the nucleic acid sequence encoding the tryptophan producing enzyme comprises serA. Accordingly, in one embodiment, the nucleic acid sequence comprising the serA gene has at least about 80% identity with SEQ ID NO: 864. In one embodiment, the nucleic acid sequence comprising the serA gene has at least about 90% identity with SEQ ID NO: 864. In another embodiment, the nucleic acid sequence comprising the serA gene has at least about 95% identity with SEQ ID NO: 864. Accordingly, in one embodiment, the nucleic acid sequence comprising the serA gene has at least about 85%, 86%, 87%, 88%, 89%, 90%, 91%, 92%, 93%, 94%, 95%, 96%, 97%, 98%, or 99% identity with SEQ ID NO: 864. In another embodiment, the nucleic acid sequence comprising the serA gene comprises SEQ ID NO: 864. In yet another embodiment the nucleic acid sequence comprising the serA gene consists of SEQ ID NO: 864.

In some embodiments, the disclosure provides novel nucleic acids for producing tryptophan. In some embodiments, the nucleic acid comprises gene sequence encoding one or more tryptophan production enzyme(s). In one of the nucleic acid embodiments described herein, the nucleic acid sequence encoding the tryptophan producing enzyme comprises trpE(fbr). Accordingly, in one embodiment, the nucleic acid sequence comprising the trpE(fbr) gene has at least about 80% identity with SEQ ID NO: 879. In one embodiment, the nucleic acid sequence comprising the trpE(fbr) gene has at least about 90% identity with SEQ ID NO: 879. In another embodiment, the nucleic acid sequence comprising the trpE(fbr) gene has at least about 95% identity with SEQ ID NO: 879. Accordingly, in one embodiment, the nucleic acid sequence comprising the trpE(fbr) gene has at least about 85%, 86%, 87%, 88%, 89%, 90%, 91%, 92%, 93%, 94%, 95%, 96%, 97%, 98%, or 99% identity with SEQ ID NO: 879. In another embodiment, the nucleic acid sequence comprising the trpE(fbr) gene comprises SEQ ID NO: 879. In yet another embodiment the nucleic acid sequence comprising the trpE(fbr) gene consists of SEQ ID NO: 879.

In one of the nucleic acid embodiments described herein, the kynurenine degradation enzyme comprises Kynureninase (*Pseudomonase fluorescens*). In one embodiment, the nucleic acid sequence encodes a polypeptide, which has at least about 80% identity with SEQ ID NO: 65. In one embodiment, the nucleic acid sequence encodes a polypeptide, which has at least about 90% identity with SEQ ID NO: 65. In another embodiment, the nucleic acid sequence encodes a polypeptide, which has at least about 95% identity with SEQ ID NO: 65. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 65. In another embodiment, the nucleic acid sequence encodes a polypeptide, which comprises a sequence which encodes SEQ ID NO: 65. In yet another embodiment, the nucleic acid sequence encodes a polypeptide, which consists of a sequence which encodes SEQ ID NO: 65.

In one of the nucleic acid embodiments described herein, the kynurenine degradation enzyme comprises Kynureninase (Human). In one embodiment, the nucleic acid sequence encodes a polypeptide, which has at least about 80% identity with SEQ ID NO: 66. In one embodiment, the nucleic acid sequence encodes a polypeptide, which has at least about 90% identity with SEQ ID NO: 66. In another embodiment, the nucleic acid sequence encodes a polypeptide, which has at least about 95% identity with SEQ ID NO: 66. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 66. In another embodiment, the nucleic acid sequence encodes a polypeptide, which comprises a sequence which encodes SEQ ID NO: 66. In yet another embodiment, the nucleic acid sequence encodes a polypeptide, which consists of a sequence which encodes SEQ ID NO: 66.

In one of the nucleic acid embodiments described herein, the kynurenine degradation enzyme comprises Kynureninase (*Shewanella*)

In one embodiment, the nucleic acid sequence encodes a polypeptide, which has at least about 80% identity with SEQ ID NO: 67. In one embodiment, the nucleic acid sequence encodes a polypeptide, which has at least about 90% identity with SEQ ID NO: 67. In another embodiment, the nucleic acid sequence encodes a polypeptide, which has at least about 95% identity with SEQ ID NO: 67. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 67. In another embodiment, the nucleic acid sequence encodes a polypeptide, which comprises a sequence which encodes SEQ ID NO: 67. In yet another embodiment, the nucleic acid sequence encodes a polypeptide, which consists of a sequence which encodes SEQ ID NO: 67.

In one of the nucleic acid embodiments described herein, the tryptophan production enzyme comprises TrpE. In one embodiment, the nucleic acid sequence encodes a polypeptide, which has at least about 80% identity with SEQ ID NO: 55. In one embodiment, the nucleic acid sequence encodes a polypeptide, which has at least about 90% identity with SEQ ID NO: 55. In another embodiment, the nucleic acid sequence encodes a polypeptide, which has at least about 95% identity with SEQ ID NO: 55. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 55. In another embodiment, the nucleic acid sequence encodes a polypeptide, which comprises a sequence which encodes SEQ ID NO: 55. In yet another embodiment, the nucleic acid sequence encodes a polypeptide, which consists of a sequence which encodes SEQ ID NO: 55.

In one of the nucleic acid embodiments described herein, the tryptophan production enzyme comprises trpD. In one embodiment, the nucleic acid sequence encodes a polypeptide, which has at least about 80% identity with SEQ ID NO: 56. In one embodiment, the nucleic acid sequence encodes a polypeptide, which has at least about 90% identity with SEQ ID NO: 56. In another embodiment, the nucleic acid sequence encodes a polypeptide, which has at least about 95% identity with SEQ ID NO: 56. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 56. In another embodiment, the nucleic acid sequence encodes a polypeptide, which comprises a sequence which encodes SEQ ID NO: 56. In yet another embodiment, the nucleic acid sequence encodes a polypeptide, which consists of a sequence which encodes SEQ ID NO: 56.

In one of the nucleic acid embodiments described herein, the tryptophan production enzyme enzyme comprises TrpC. In one embodiment, the nucleic acid sequence encodes a polypeptide, which has at least about 80% identity with SEQ ID NO: 57. In one embodiment, the nucleic acid sequence encodes a polypeptide, which has at least about 90% identity with SEQ ID NO: 57. In another embodiment, the nucleic acid sequence encodes a polypeptide, which has at least about 95% identity with SEQ ID NO: 57. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 57. In another embodiment, the nucleic acid sequence encodes a polypeptide, which comprises a sequence which encodes SEQ ID NO: 57. In yet another embodiment, the nucleic acid sequence encodes a polypeptide, which consists of a sequence which encodes SEQ ID NO: 57.

In one of the nucleic acid embodiments described herein, the tryptophan production enzyme comprises TrpB. In one embodiment, the nucleic acid sequence encodes a polypeptide, which has at least about 80% identity with SEQ ID NO: 58. In one embodiment, the nucleic acid sequence encodes a polypeptide, which has at least about 90% identity with SEQ ID NO: 58. In another embodiment, the nucleic acid sequence encodes a polypeptide, which has at least about 95% identity with SEQ ID NO: 58. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 58. In another embodiment, the nucleic acid sequence encodes a polypeptide, which comprises a sequence which encodes SEQ ID NO: 58. In yet another embodiment, the nucleic acid sequence encodes a polypeptide, which consists of a sequence which encodes SEQ ID NO: 58.

In one of the nucleic acid embodiments described herein, the tryptophan production enzyme comprises TrpA. In one embodiment, the nucleic acid sequence encodes a polypeptide, which has at least about 80% identity with SEQ ID NO: 59. In one embodiment, the nucleic acid sequence encodes a polypeptide, which has at least about 90% identity with SEQ ID NO: 59. In another embodiment, the nucleic acid sequence encodes a polypeptide, which has at least about 95% identity with SEQ ID NO: 59. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 59. In another embodiment, the nucleic acid sequence encodes a polypeptide, which comprises a sequence which encodes SEQ ID NO: 59. In yet another embodiment, the nucleic acid sequence encodes a polypeptide, which consists of a sequence which encodes SEQ ID NO: 59.

In one of the nucleic acid embodiments described herein, the tryptophan production enzyme comprises AroG(fbr). In one embodiment, the nucleic acid sequence encodes a polypeptide, which has at least about 80% identity with SEQ ID NO: 60. In one embodiment, the nucleic acid sequence encodes a polypeptide, which has at least about 90% identity with SEQ ID NO: 60. In another embodiment, the nucleic acid sequence encodes a polypeptide, which has at least about 95% identity with SEQ ID NO: 60. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 60. In another embodiment, the nucleic acid sequence encodes a polypeptide, which comprises a sequence which encodes SEQ ID NO: 60. In yet another embodiment, the nucleic acid sequence encodes a polypeptide, which consists of a sequence which encodes SEQ ID NO: 60.

In one of the nucleic acid embodiments described herein, the tryptophan production enzyme comprises TrpE(fbr). In one embodiment, the nucleic acid sequence encodes a polypeptide, which has at least about 80% identity with SEQ ID NO: 61. In one embodiment, the nucleic acid sequence encodes a polypeptide, which has at least about 90% identity with SEQ ID NO: 61. In another embodiment, the nucleic acid sequence encodes a polypeptide, which has at least about 95% identity with SEQ ID NO: 61. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 61. In another embodiment, the nucleic acid sequence encodes a polypeptide, which comprises a sequence which encodes SEQ ID NO: 61. In yet another embodiment, the nucleic acid sequence encodes a polypeptide, which consists of a sequence which encodes SEQ ID NO: 61.

In one of the nucleic acid embodiments described herein, the tryptophan production enzyme comprises SerA. In one embodiment, the nucleic acid sequence encodes a polypeptide, which has at least about 80% identity with SEQ ID NO: 62. In one embodiment, the nucleic acid sequence encodes a polypeptide, which has at least about 90% identity with SEQ ID NO: 62. In another embodiment, the nucleic acid sequence encodes a polypeptide, which has at least about 95% identity with SEQ ID NO: 62. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 62. In another embodiment, the nucleic acid sequence encodes a polypeptide, which comprises a sequence which encodes SEQ ID NO: 62. In yet another embodiment, the nucleic acid sequence encodes a polypeptide, which consists of a sequence which encodes SEQ ID NO: 62.

In one of the nucleic acid embodiments described herein, the tryptophan production enzyme comprises SerA(fbr). In one embodiment, the nucleic acid sequence encodes a polypeptide, which has at least about 80% identity with SEQ ID NO: 63. In one embodiment, the nucleic acid sequence encodes a polypeptide, which has at least about 90% identity with SEQ ID NO: 63. In another embodiment, the nucleic acid sequence encodes a polypeptide, which has at least about 95% identity with SEQ ID NO: 63. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 63. In another embodiment, the nucleic acid sequence encodes a polypeptide, which comprises a sequence which encodes SEQ ID NO: 63. In yet another embodiment, the nucleic acid sequence encodes a polypeptide, which consists of a sequence which encodes SEQ ID NO: 63.

In some embodiments, the disclosure provides novel nucleic acids for tryptophan production. In some embodiments, the nucleic acid comprises gene sequence encoding one or more the tryptophan production enzyme cassette(s). In one of the nucleic acid embodiments described herein, the nucleic acid sequence encoding the tryptophan production enzyme cassette comprises a nucleic acid sequence comprising Fbr-aroG-serA. Accordingly, in one embodiment, nucleic acid sequence comprising the Fbr-aroG-serA has at least about 80% identity with SEQ ID NO: 863. In one embodiment, the nucleic acid sequence comprising Fbr-aroG-serA has at least about 90% identity with SEQ ID NO: 863. In one embodiment, the nucleic acid sequence comprising Fbr-aroG-serA has at least about 95% identity with SEQ ID NO: 863. In one embodiment, the nucleic acid sequence comprising Fbr-aroG-serA has at least about 85%, 86%, 87%, 88%, 89%, 90%, 91%, 92%, 93%, 94%, 95%, 96%, 97%, 98%, or 99% identity with SEQ ID NO: 863. In another embodiment, the nucleic acid sequence comprising Fbr-aroG-serA comprises the sequence of SEQ ID NO: 863. In another embodiment, the nucleic acid sequence comprising Fbr-aroG-serA consists of the sequence of SEQ ID NO: 863.

In some embodiments, the disclosure provides novel nucleic acids for tryptophan production. In some embodiments, the nucleic acid comprises gene sequence encoding the tryptophan production enzyme cassette(s). In one of the nucleic acid embodiments described herein, the nucleic acid sequence encoding the tryptophan production enzyme cassette comprises a nucleic acid sequence comprising TrpEDCBA. Accordingly, in one embodiment, nucleic acid sequence comprising the TrpEDCBA has at least about 80% identity with SEQ ID NO: 872. In one embodiment, the nucleic acid sequence comprising TrpEDCBA has at least about 90% identity with SEQ ID NO: 872. In one embodiment, the nucleic acid sequence comprising TrpEDCBA has at least about 95% identity with SEQ ID NO: 872. In one embodiment, the nucleic acid sequence comprising TrpEDCBA has at least about 85%, 86%, 87%, 88%, 89%, 90%, 91%, 92%, 93%, 94%, 95%, 96%, 97%, 98%, or 99% identity with SEQ ID NO: 872. In another embodiment, the nucleic acid sequence comprising TrpEDCBA comprises the sequence of SEQ ID NO: 872. In another embodiment, the nucleic acid sequence comprising TrpEDCBA consists of the sequence of SEQ ID NO: 872.

In some embodiments, the disclosure provides novel nucleic acids for tryptophan production. In some embodiments, the nucleic acid comprises gene sequence encoding the tryptophan production enzyme cassette(s). In one of the nucleic acid embodiments described herein, the nucleic acid sequence encoding the tryptophan production enzyme cassette comprises a nucleic acid sequence comprising fbrS40FTrpE-DCBA. Accordingly, in one embodiment, nucleic acid sequence comprising fbrS40FTrpE-DCBA has at least about 80% identity with SEQ ID NO: 878. In one embodiment, the nucleic acid sequence comprising fbrS40FTrpE-DCBA has at least about 90% identity with SEQ ID NO: 878. In one embodiment, the nucleic acid sequence comprising fbrS40FTrpE-DCBA has at least about 95% identity with SEQ ID NO: 878. In one embodiment, the nucleic acid sequence comprising fbrS40FTrpE-DCBA has at least about 85%, 86%, 87%, 88%, 89%, 90%, 91%, 92%, 93%, 94%, 95%, 96%, 97%, 98%, or 99% identity with SEQ ID NO: 878. In another embodiment, the nucleic acid sequence comprising fbrS40FTrpE-DCBA comprises the sequence of SEQ ID NO: 878. In another embodiment, the nucleic acid sequence comprising fbrS40FTrpE-DCBA consists of the sequence of SEQ ID NO: 878.

In any of the nucleic acid embodiments described above, the one or more nucleic acid sequence(s) for producing the anti-cancer molecule combinations are operably linked to one or more directly or indirectly inducible promoter(s). In some embodiments, the one or more nucleic acid sequence(s) are operably linked to a directly or indirectly inducible promoter that is induced under exogeneous environmental conditions, e.g., conditions found in the gut, the tumor microenvironment or other tissue specific conditions. In some embodiments, the one or more nucleic acid sequence(s) are operably linked to a directly or indirectly inducible promoter that is induced by metabolites found in the gut, the tumor microenvironment or other specific conditions. In some embodiments, the one or more nucleic acid sequence(s) are operably linked to a directly or indirectly inducible promoter that is induced under low-oxygen or anaerobic conditions. In some embodiments, the one or more nucleic acid sequence(s) are operably linked to a directly or indirectly inducible promoter that is induced under inflammatory conditions (e.g., RNS, ROS), as described herein. In some embodiments, the one or more nucleic acid sequence(s) are operably linked to a directly or indirectly inducible promoter that is induced under immunosuppressive conditions, e.g., as found in the tumor, as described herein. In some embodiments, the two or more gene sequence(s) are linked to a directly or indirectly inducible promoter that is induced by exposure a chemical or nutritional inducer, which may or may not be present under in vivo conditions and which may be present during in vitro conditions (such as strain culture, expansion, manufacture), such as tetracycline or arabinose, or others described herein. In some embodiments, the two or more payloads are all linked to a constitutive promoter. Such constitutive promoters are described in Table 48-Table 58 herein. In some embodiments, the two or more gene sequence are operably linked to the same promoter sequences. In some embodiments, the two or more gene sequence are operably linked to two or more different promoter sequences, which can either all be constitutive (same or different constitutive promoters), all inducible (by same or different inducers), or a mix of constitutive and inducible promoters.

In one embodiment, the one or more nucleic acid sequence(s) encoding one or more anti-cancer molecules is located on a plasmid in the bacterial cell. In another embodiment, the one or more nucleic acid sequence(s) encoding one or more anti-cancer molecules is located in the chromosome of the bacterial cell.

Secretion

In any of the embodiments described herein, in which the genetically engineered organism, e.g., engineered bacteria or engineered OV, produces a protein, polypeptide, peptide, or other anti-cancer, DNA, RNA, small molecule or other molecule intended to be secreted from the microorganism, the engineered microorganism may comprise a secretion mechanism and corresponding gene sequence(s) encoding the secretion system.

In some embodiments, the genetically engineered bacteria further comprise a native secretion mechanism or non-native secretion mechanism that is capable of secreting the anti-cancera molecule from the bacterial cytoplasm in the extracellular environment. Many bacteria have evolved sophisticated secretion systems to transport substrates across the bacterial cell envelope. Substrates, such as small molecules, proteins, and DNA, may be released into the extracellular space or periplasm (such as the gut lumen or other space), injected into a target cell, or associated with the bacterial membrane.

In Gram-negative bacteria, secretion machineries may span one or both of the inner and outer membranes. In some embodiments, the genetically engineered bacteria further comprise a non-native double membrane-spanning secretion system. Double membraneMembrane-spanning secretion systems include, but are not limited to, the type I secretion system (T1SS), the type II secretion system (T2SS), the type III secretion system (T3SS), the type IV secretion system (T4SS), the type VI secretion system (T6SS), and the resistance-nodulation-division (RND) family of multi-drug efflux pumps (Pugsley 1993; Gerlach et al., 2007; Collinson et al., 2015; Costa et al., 2015; Reeves et al., 2015; WO2014138324A1, incorporated herein by reference). Examples of such secretion systems are shown in FIGS. 45-51. Mycobacteria, which have a Gram-negative-like cell envelope, may also encode a type VII secretion system (T7SS) (Stanley et al., 2003). With the exception of the T2SS, double membrane-spanning secretions generally transport substrates from the bacterial cytoplasm directly into the extracellular space or into the target cell. In contrast, the T2SS and secretion systems that span only the outer membrane may use a two-step mechanism, wherein substrates are first translocated to the periplasm by inner membrane-spanning transporters, and then transferred to the outer membrane or secreted into the extracellular space. Outer membrane-spanning secretion systems include, but are not limited to, the type V secretion or autotransporter system or autosecreter system (T5SS), the curli secretion system, and the chaperone-usher pathway for pili assembly (Saier, 2006; Costa et al., 2015).

In some embodiments in which the one or more proteins of interest or therapeutic proteins are secreted or exported from the microorganism, the engineered microorganism comprises gene sequence(s) that includes a secretion tag. In some embodiments, the one or more proteins of interest or therapeutic proteins include a "secretion tag" of either RNA or peptide origin to direct the one or more proteins of interest or therapeutic proteins to specific secretion systems. For example, a secretion tag for the Type I Hemolysin secretion system is encoded in the C-terminal 53 amino acids of the alpha hemolysin protein (HlyA).

In some embodiments, a Hemolysin-based Secretion System is used to secrete the molecule of interest, e.g., therapeutic peptide. Type I Secretion systems offer the advantage of translocating their passenger peptide directly from the cytoplasm to the extracellular space, obviating the two-step process of other secretion types. FIG. 79 shows the alpha-hemolysin (HlyA) of uropathogenic *Escherichia coli*. This pathway uses HlyB, an ATP-binding cassette transporter; HlyD, a membrane fusion protein; and TolC, an outer membrane protein. The assembly of these three proteins forms a channel through both the inner and outer membranes. HlyB inserts into inner membrane to form a pore, HlyD aligns HlyB with TolC (outer membrane pore) thereby forming a channel through inner and outer membrane. Natively, this channel is used to secrete HlyA, however, to secrete the therapeutic peptide of the present disclosure, the secretion signal-containing C-terminal portion of HlyA is fused to the C-terminal portion of a therapeutic peptide (star) to mediate secretion of this peptide. The C-terminal secretion tag can be removed by either an autocatalytic or protease-catalyzed e.g., OmpT cleavage thereby releasing the one or more proteins of interest or therapeutic proteins into the extracellular milieu. In some embodiments the one or more proteins of interest or therapeutic proteins contain expressed as fusion protein with the 53 amino acids of the C termini of alpha-hemolysin (hlyA) of *E. coli* CFT073 (C terminal secretion tag).

In some embodiments, a Type V Autotransporter Secretion System is used to secrete the molecule of interest, e.g., therapeutic peptide. The Type V Auto-secretion System utilizes an N-terminal Sec-dependent peptide tag (inner membrane) and C-terminal tag (outer-membrane). This system uses the Sec-system to get from the cytoplasm to the periplasm. The C-terminal tag then inserts into the outer membrane forming a pore through which the "passenger protein" threads through. Due to the simplicity of the machinery and capacity to handle relatively large protein fluxes, the Type V secretion system is attractive for the extracellular production of recombinant proteins. As shown in FIG. 78, a therapeutic peptide (star) can be fused to an N-terminal secretion signal, a linker, and the beta-domain of an autotransporter. The N-terminal, Sec-dependent signal sequence directs the protein to the SecA-YEG machinery which moves the protein across the inner membrane into the periplasm, followed by subsequent cleavage of the signal sequence. The Beta-domain is recruited to the Bam complex ('Beta-barrel assembly machinery') where the beta-domain is folded and inserted into the outer membrane as a beta-barrel structure. The therapeutic peptide is threaded through the hollow pore of the beta-barrel structure ahead of the linker sequence. Once across the outer membrane, the passenger is released from the membrane-embedded C-terminal tag by either an autocatalytic, intein-like mechanism (left side of Bam complex) or via a membrane-bound protease (black scissors; right side of Bam complex) (i.e., OmpT). For example, a membrane-associated peptidase to a complimentary protease cut site in the linker. Thus, in some embodiments, the secreted molecule, such as a heterologous protein or peptide comprises an N-terminal secretion signal, a linker, and beta-domain of an autotransporter so as to allow the molecule to be secreted from the bacteria.

The N-terminal tag is removed by the Sec system. Thus, in some embodiments, the secretion system is able to remove this tag before secreting the one or more proteins of interest or therapeutic proteins, from the engineered bacteria. In the Type V auto-secretion-mediated secretion the N-terminal peptide secretion tag is removed upon translocation of the "passenger" peptide from the cytoplasm into the periplasmic compartment by the native Sec system. Further, once the auto-secretor is translocated across the outer membrane the C-terminal secretion tag can be removed by either an autocatalytic or protease-catalyzed e.g., OmpT cleavage thereby releasing the anti-cancer molecule(s) into the extracellular milieu.

In some embodiments, the genetically engineered bacteria of the invention comprise a type III or a type III-like secretion system (T3SS) from *Shigella, Salmonella, E. coli, Bivrio, Burkholderia, Yersinia, Chlamydia*, or *Pseudomonas*. The traditional T3SS is capable of transporting a protein from the bacterial cytoplasm to the host cytoplasm through a needle complex. In the Type III traditional secretion system, the basal body closely resembles the flagella, however, instead of a "tail"/whip, the traditional T3SS has a syringe to inject the passenger proteins into host cells. The secretion tag is encoded by an N-terminal peptide (lengths vary and there are several different tags, see PCT/US14/020972). The N-terminal tag is not removed from the polypeptides in this secretion system.

The T3SS may be modified to secrete the molecule from the bacterial cytoplasm, but not inject the molecule into the host cytoplasm. Thus, the molecule is secreted into the gut lumen, tumor microenvironment, or other extracellular space. In some embodiments, the genetically engineered bacteria comprise said modified T3SS and are capable of secreting the molecule of interest from the bacterial cytoplasm. In some embodiments, the secreted molecule, comprises a type III secretion sequence that allows the molecule of interest to be secreted from the bacteria.

In the Flagellar modified Type III Secretion, the tag is encoded in 5'untranslated region of the mRNA and thus there is no peptide tag to cleave/remove. This modified system does not contain the "syringe" portion and instead uses the basal body of the flagella structure as the pore to translocate across both membranes and out through the forming flagella. If the fliC/fliD genes (encoding the flagella "tail"/whip) are disrupted the flagella cannot fully form and this promotes overall secretion. In some embodiments, the tail portion can be removed entirely.

In some embodiments, a flagellar type III secretion pathway is used to secrete the molecule of interest. In some embodiments, an incomplete flagellum is used to secrete a therapeutic peptide of interest by recombinantly fusing the peptide to an N-terminal flagellar secretion signal of a native flagellar component. In this manner, the intracellularly expressed chimeric peptide can be mobilized across the inner and outer membranes into the surrounding host environment.

For example, a modified flagellar type III secretion apparatus in which untranslated DNA fragment upstream of the gene fliC (encoding flagellin), e.g., a 173-bp region, is fused to the gene encoding the heterologous protein or peptide can be used to secrete polypeptides of interest (See, e.g., Majander et al., Extracellular secretion of polypeptides using a modified *Escherichia coli* flagellar secretion apparatus. Nat Biotechnol. 2005 April; 23(4):475-81). In some cases, the untranslated region from the fliC loci may not be sufficient to mediate translocation of the passenger peptide through the flagella. Here it may be necessary to extend the N-terminal signal into the amino acid coding sequence of FliC, for example, by using the 173 bp of untranslated region along with the first 20 amino acids of FliC (see, e.g., Duan et al., Secretion of Insulinotropic Proteins by Commensal Bacteria: Rewiring the Gut To Treat Diabetes, Appl. Environ. Microbiol. December 2008 vol. 74 no. 23 7437-7438).

In alternate embodiments, the genetically engineered bacteria further comprise a non-native single membrane-spanning secretion system. Single membrane-spanning transporters may act as a component of a secretion system, or may export substrates independently. Such transporters include, but are not limited to, ATP-binding cassette translocases, flagellum/virulence-related translocases, conjugation-related translocases, the general secretory system (e.g., the SecYEG complex in E. coli), the accessory secretory system in mycobacteria and several types of Gram-positive bacteria (e.g., Bacillus anthracis, Lactobacillus johnsonii, Corynebacterium glutamicum, Streptococcus gordonii, Staphylococcus aureus), and the twin-arginine translocation (TAT) system (Saier, 2006; Rigel and Braunstein, 2008; Albiniak et al., 2013). It is known that the general secretory and TAT systems can both export substrates with cleavable N-terminal signal peptides into the periplasm, and have been explored in the context of biopharmaceutical production. The TAT system may offer particular advantages, however, in that it is able to transport folded substrates, thus eliminating the potential for premature or incorrect folding. In certain embodiments, the genetically engineered bacteria comprise a TAT or a TAT-like system and are capable of secreting the anti-cancer molecule of interest from the bacterial cytoplasm. One of ordinary skill in the art would appreciate that the secretion systems disclosed herein may be modified to act in different species, strains, and subtypes of bacteria, and/or adapted to deliver different payloads.

In order to translocate a protein, e.g., therapeutic polypeptide, to the extracellular space, the polypeptide must first be translated intracellularly, mobilized across the inner membrane and finally mobilized across the outer membrane. Many effector proteins (e.g., therapeutic polypeptides)—particularly those of eukaryotic origin—contain disulphide bonds to stabilize the tertiary and quaternary structures. While these bonds are capable of correctly forming in the oxidizing periplasmic compartment with the help of periplasmic chaperones, in order to translocate the polypeptide across the outer membrane the disulphide bonds must be reduced and the protein unfolded again.

One way to secrete properly folded proteins in gram-negative bacteria—particularly those requiring disulphide bonds—is to target the reducing-environment periplasm in conjunction with a destabilizing outer membrane. In this manner the protein is mobilized into the oxidizing environment and allowed to fold properly. In contrast to orchestrated extracellular secretion systems, the protein is then able to escape the periplasmic space in a correctly folded form by membrane leakage. These "leaky" gram-negative mutants are therefore capable of secreting bioactive, properly disulphide-bonded polypeptides. In some embodiments, the genetically engineered bacteria have a "leaky" or de-stabilized outer membrane. Destabilizing the bacterial outer membrane to induce leakiness can be accomplished by deleting or mutagenizing genes responsible for tethering the outer membrane to the rigid peptidoglycan skeleton, including for example, lpp, ompC, ompA, ompF, tolA, tolB, pal, degS, degP, and nlpI. Lpp is the most abundant polypeptide in the bacterial cell existing at ~500,000 copies per cell and functions as the primary 'staple' of the bacterial cell wall to the peptidoglycan. 1. Silhavy, T. J., Kahne, D. & Walker, S. The bacterial cell envelope. Cold Spring Harb Perspect Biol 2, a000414 (2010). TolA-PAL and OmpA complexes function similarly to Lpp and are other deletion targets to generate a leaky phenotype. Additionally, leaky phenotypes have been observed when periplasmic proteases are inactivated. The periplasm is very densely packed with protein and therefore encode several periplasmic proteins to facilitate protein turnover. Removal of periplasmic proteases such as degS, degP or nlpI can induce leaky phenotypes by promoting an excessive build-up of periplasmic protein. Mutation of the proteases can also preserve the effector polypeptide by preventing targeted degradation by these proteases. Moreover, a combination of these mutations may synergistically enhance the leaky phenotype of the cell without major sacrifices in cell viability. Thus, in some embodiments, the engineered bacteria have one or more deleted or mutated membrane genes. In some embodiments, the engineered bacteria have a deleted or mutated lpp gene. In some embodiments, the engineered bacteria have one or more deleted or mutated gene(s), selected from ompA, ompA, and ompF genes. In some embodiments, the engineered bacteria have one or more deleted or mutated gene(s), selected from tolA, tolB, and pal genes. in some embodiments, the engineered bacteria have one or more deleted or mutated periplasmic protease genes. In some embodiments, the engineered bacteria have one or more deleted or mutated periplasmic protease genes selected from degS, degP, and nlpI. In some embodiments, the engineered bacteria have one or more deleted or mutated gene(s), selected from lpp, ompA, ompF, tolA, tolB, pal, degS, degP, and nlpI genes.

To minimize disturbances to cell viability, the leaky phenotype can be made inducible by placing one or more membrane or periplasmic protease genes, e.g., selected from lpp, ompA, ompF, tolA, tolB, pal, degS, degP, and nlpI, under the control of an inducible promoter. For example, expression of lpp or other cell wall stability protein or periplasmic protease can be repressed in conditions where the therapeutic polypeptide needs to be delivered (secreted). For instance, under inducing conditions a transcriptional repressor protein or a designed antisense RNA can be expressed which reduces transcription or translation of a target membrane or periplasmic protease gene. Conversely, overexpression of certain peptides can result in a destabilized phenotype, e.g., overexpression of colicins or the third topological domain of TolA, wherein peptide overexpression can be induced in conditions in which the therapeutic polypeptide needs to be delivered (secreted). These sorts of strategies would decouple the fragile, leaky phenotypes from biomass production. Thus, in some embodiments, the engineered bacteria have one or more membrane and/or periplasmic protease genes under the control of an inducible promoter.

Table 59 and Table 60 below lists secretion systems for Gram positive bacteria and Gram negative bacteria.

TABLE 59

Secretion systems for gram positive bacteria

| Bacterial Strain | Relevant Secretion System |
|---|---|
| C. novyi-NT (Gram+) | Sec pathway |
| | Twin- arginine (TAT) pathway |
| C. butryicum (Gram+) | Sec pathway |
| | Twin- arginine (TAT) pathway |
| Listeria monocytogenes (Gram+) | Sec pathway |
| | Twin- arginine (TAT) pathway |

TABLE 60

Secretion Systems for Gram negative bacteria
Protein secretary pathways (SP) in gram-negative bacteria and their descendants

| Type (Abbreviation) | Name | TC#[2] | Bacteria | Archaea | Eukarya | # Proteins/ System | Energy Source |
|---|---|---|---|---|---|---|---|
| IMPS - Gram-negative bacterial inner membrane channel-forming translocases | | | | | | | |
| ABC (SIP) | ATP binding cassette translocase | 3.A.1 | + | + | + | 3-4 | ATP |
| SEC (IISP) | General secretory translocase | 3.A.5 | + | + | + | ~12 | GTP OR ATP + PMF |
| Fla/Path (IIISP) | Flagellum/ virulence-related translocase | 3.A.6 | + | − | − | >10 | ATP |
| Conj (IVSP) | Conjugation-related translocase | 3.A.7 | + | − | − | >10 | ATP |
| Tat (IISP) | Twin-arginine targeting translocase | 2.A.64 | + | + | + (chloroplasts) | 2-4 | PMF |
| Oxa1 (YidC) | Cytochrome oxidase biogenesis family | 2.A.9 | + | + | + (mitochondria chloroplasts) | 1 | None or PMF |
| MscL | Large conductance mechanosensitive channel family | 1.A.22 | + | + | + | 1 | None |
| Holins | Holin functional superfamily | 1.E.1 •21 | + | − | − | 1 | None |
| Eukaryotic Organelles | | | | | | | |
| MPT | Mitochondrial protein translocase | 3.A.B | − | − | + (mitochondrial) | >20 | ATP |
| CEPT | Chloroplast envelope protein translocase | 3.A.9 | (+) | − | + (chloroplasts) | ≥3 | GTP |
| Bcl-2 | Eukaryotic Bcl-2 family (programmed cell death) | 1.A.21 | − | − | + | 1? | None |
| Gram-negative bacterial outer membrane channel-forming translocases | | | | | | | |
| MTB (IISP) | Main terminal branch of the general secretory translocase | 3.A.15 | +[b] | − | − | ~14 | ATP; PMF |
| FUP | Fimbrial usher protein | 1.B.11 | +[b] | − | − | 1 | None |
| AT-1 | Autotransporter-1 | 1.B.12 | +[b] | − | − | 1 | None |
| AT-2 OMF (ISP) | Autotransporter-2 | 1.B.40 | +[b] | − | − | 1 | None |
| | | 1.B.17 | +[b] | − | +(?) | 1 | None |
| TPS | | 1.B.20 | + | − | + | 1 | None |
| Secretin (IISP and IISP) | | 1.B.22 | +[b] | − | − | 1 | None |
| OmpIP | Outer membrane insertion porin | 1.B.33 | + | − | + (mitochondria; chloroplasts) | ≥4 | None? |

The above tables for gram positive and gram negative bacteria list secretion systems that can be used to secrete polypeptides and other molecules from the engineered bacteria, which are reviewed in Milton H. Saier, Jr. Microbe/ Volume 1, Number 9, 2006 "Protein Secretion Systems in Gram-Negative Bacteria Gram-negative bacteria possess many protein secretion-membrane insertion systems that apparently evolved independently", the contents of which is herein incorporated by reference in its entirety.

In some embodiments, the genetically engineered bacterial comprise a native or non-native secretion system described herein for the secretion of a anti-cancer molecule, e.g., a cytokine, antibody (e.g., scFv), metabolic enzyme, e.g., kynureninase, and others described herein.

TABLE 61

Polypeptide Sequences of exemplary secretion tags

| Description | Sequence |
|---|---|
| PhoA<br>SEQ ID NO: 745 | MKQSTIALALLPLLFTPVTKA |
| PhoA<br>SEQ ID NO: 746 | KQSTIALALLPLLFTPVTKA |
| OmpF<br>SEQ ID NO: 747 | MMKRNILAVIVPALLVAGTANA |
| cvaC<br>SEQ ID NO: 748 | MRTLTLNELDSVSGG |
| TorA<br>SEQ ID NO: 749 | MNNNDLFQASRRRFLAQLGGLTVAGMLGTSLLTPRRA TAAQAA |
| fdnG<br>SEQ ID NO: 750 | MDVSRRQFFKICAGGMAGTTVAALGFAPKQALA |
| dmsA<br>SEQ ID NO: 751 | MKTKIPDAVLAAEVSRRGLVKTTAIGGLAMASSALTLP FSRIAHA |
| PelB<br>SEQ ID NO: 752 | KYLLPTAAAGLLLLAAQPAMA |
| HlyA secretion signal<br>SEQ ID NO: 753 | LNPLINEISKIISAAGNFDVKEERAAASLLQLSGNASDFS YGRNSITLTASA |
| HlyA secretion signal<br>SEQ ID NO: 754 | CTTAATCCATTAATTAATGAAATCAGCAAAATCATTT CAGCTGCAGGTAATTTTGATGTTAAAGAGGAAAGAG CTGCAGCTTCTTTATTGCAGTTGTCCGGTAATGCCAG TGATTTTTCATATGGACGGAACTCAATAACTTTGACA GCATCAGCATAA. |

In some embodiments, genetically engineered bacteria comprise a nucleic acid sequence that encodes a polypeptide which is at least about 80%, at least about 85%, at least about 90%, at least about 95%, or at least about 99% homologous to the DNA sequence of SEQ ID NO: 745, SEQ ID NO: 746, SEQ ID NO: 747, SEQ ID NO: 748, SEQ ID NO: 749, SEQ ID NO: 750, SEQ ID NO: 751, SEQ ID NO: 752, SEQ ID NO: 753, and/or SEQ ID NO: 754.

Any secretion tag or secretion system can be combined with any cytokine described herein, and can be used to generate a construct (plasmid based or integrated) which is driven by an directly or indirectly inducible or constitutive promoter described herein. In some embodiments, the secretion system is used in combination with one or more genomic mutations, which leads to the leaky or diffusible outer membrane phenotype (DOM), including but not limited to, lpp, nlP, tolA, PAL.

In some embodiments, the secretion system is selected from the type III flagellar, modified type III flagellar, type I (e.g., hemolysin system), type II, type IV, type V, type VI, and type VII secretion systems, resistance-nodulation-division (RND) multi-drug efflux pumps, a single membrane secretion system, Sec and, TAT secretion systems.

Any of the secretion systems described herein may according to the disclosure be employed to secrete the polypeptides of interest. In some embodiments, the therapeutic proteins secreted by the genetically engineered bacteria are modified to increase resistance to proteases, e.g. intestinal proteases.

In some embodiments, the gene sequences encoding the polypeptide of interest for secretion are operably linked to one or more directly or indirectly inducible promoter(s). In some embodiments, the gene sequences encoding the polypeptide of interest for secretion are operably linked to a directly or indirectly inducible promoter that is induced under exogenous environmental conditions, e.g., conditions found in the gut, the tumor microenvironment or other tissue specific conditions. In some embodiments, the gene sequences encoding the polypeptide of interest for secretion are operably linked to a directly or indirectly inducible promoter that is induced by metabolites found in the gut, the tumor microenvironment or other specific conditions. In some embodiments, the gene sequences encoding the polypeptide of interest for secretion are operably linked to a directly or indirectly inducible promoter that is induced under low-oxygen or anaerobic conditions. In some embodiments, the gene sequences encoding the polypeptide of interest for secretion are operably linked to a directly or indirectly inducible promoter that is induced under inflammatory conditions (e.g., RNS, ROS), as described herein. In some embodiments, the gene sequences encoding the polypeptide of interest for secretion are operably linked to a directly or indirectly inducible promoter that is induced under immunosuppressive conditions, e.g., as found in the tumor, as described herein. In some embodiments, two or more gene gene(s) are linked to a directly or indirectly inducible promoter that is induced by exposure a chemical or nutritional inducer, which may or may not be present under in vivo conditions and which may be present during in vitro conditions (such as strain culture, expansion, manufacture), such as tetracycline or arabinose, or others described herein. In some embodiments, the two or more payloads are all linked to a constitutive promoter. Such constitutive promoters are described in Table 48-Table 58 herein. In some embodiments, the two or more gene sequence are operably linked to the same promoter sequences. In some embodiments, the two or more gene sequence are operably linked to two or more different promoter sequences, which can either all be constitutive (same or different constitutive promoters), all inducible (by same or different inducers), or a mix of constitutive and inducible promoters.

In one embodiment, the one or more nucleic acid sequence(s) encoding one or more polypeptides of interest for secretion is located on a plasmid in the bacterial cell. In another embodiment, the one or more nucleic acid sequence(s) encoding one or more anti-cancer molecules is located in the chromosome of the bacterial cell.

In some embodiments, any one or more of the described circuits are present on one or more plasmids (e.g., high copy or low copy) or are integrated into one or more sites in the microorganisms chromosome. Also, in some embodiments, the genetically engineered microorganisms are further capable of expressing any one or more of the described circuits and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, (6) one or more surface display circuits, such as any of the surface display circuits described herein and otherwise known in the art and (7) one or more circuits for the production or degradation of one or more metabolites (e.g., kynurenine, tryptophan, adenosine, arginine) described herein (8) one or more surface display circuits, such as any of the surface display circuits described herein and otherwise known in the art and (9) combinations of one or more of such additional circuits.

Non-limiting examples of proteins of interest include cytokines, e.g., IL-12, IL-2, IL-15, IL-18, IL-7, IL-21, CD40 agonist, CD40 agonist, CD226 agonist, CD137 agonist, ICOS agonist, OX040 agonist, GM-CSF, tryptophan and/or arginine synthesis enzymes, antibodies, e.g., scFvs, including but not limited to checkpoint inhibitors (e.g., PD1, PDL1, CTLA4, and others described herein), kynureninase, adenosing degradation enzymes. These polypeptides may be mutated to increase stability, resistance to protease digestion, and/or activity.

TABLE 62

Comparison of Secretion systems for secretion of polypeptide from engineered bacteria

| Secretion System | Tag | Cleavage | Advantages | Other features |
|---|---|---|---|---|
| Modified Type III (flagellar) | mRNA (or N-terminal) | No cleavage necessary | No peptide tag Endogenous | May not be as suited for larger proteins Deletion of flagellar genes |
| Type V autotransport | N- and C-terminal | Yes | Large proteins Endogenous Cleavable | 2-step secretion |

TABLE 62-continued

Comparison of Secretion systems for secretion of polypeptide from engineered bacteria

| Secretion System | Tag | Cleavage | Advantages | Other features |
|---|---|---|---|---|
| Type I | C-terminal | No | | Tag; Exogenous Machinery |
| Diffusible Outer Membrane (DOM) | N-terminal | Yes | Disulfide bond formation | May affect cell fragility/ survivability/ growth/yield |

In some embodiments, the therapeutic polypeptides of interest are secreted using components of the flagellar type III secretion system. In a non-limiting example, such a therapeutic polypeptide of interest, such as, IL-12, IL-2, IL-15, IL-18, IL-7, IL-21, CD40 agonist, CD40 agonist, CD226 agonist, CD137 agonist, ICOS agonist, OX040 agonist, GM-CSF, tryptophan and/or arginine synthesis enzymes, antibodies, e.g., scFvs, including but not limited to checkpoint inhibitors (e.g., PD1, PDL1, CTLA4, and others described herein, kynureninase, adenosing degradation enzymes, is assembled behind a fliC-5'UTR (e.g., 173-bp untranslated region from the fliC loci), and is driven by the native promoter. In other embodiments, the expression of the therapeutic peptide of interested secreted using components of the flagellar type III secretion system is driven by a tet-inducible promoter. In alternate embodiments, an inducible promoter such as oxygen level-dependent promoters (e.g., FNR-inducible promoter), promoters induced by IBD specific molecules or promoters induced by inflammation or an inflammatory response (RNS, ROS promoters), and promoters induced by a metabolite that may or may not be naturally present (e.g., can be exogenously added) in the gut, e.g., arabinose is used. In some embodiments, the therapeutic polypeptide of interest is expressed from a plasmid (e.g., a medium copy plasmid). In some embodiments, the therapeutic polypeptide of interest is expressed from a construct which is integrated into fliC locus (thereby deleting fliC), where it is driven by the native FliC promoter. In some embodiments, an N terminal part of FliC (e.g., the first 20 amino acids of FliC) is included in the construct, to further increase secretion efficiency.

In some embodiments, the therapeutic polypeptides of interest, e.g., IL-12, IL-2, IL-15, IL-18, IL-7, IL-21, CD40 agonist, CD40 agonist, CD226 agonist, CD137 agonist, ICOS agonist, OX040 agonist, GM-CSF, tryptophan and/or arginine synthesis enzymes, antibodies, e.g., scFvs, including but not limited to checkpoint inhibitors (e.g., PD1, PDL1, CTLA4, and others described herein), kynureninase, adenosine degradation enzymes), are secreted using via a diffusible outer membrane (DOM) system. In some embodiments, the therapeutic polypeptide of interest is fused to a N-terminal Sec-dependent secretion signal. Non-limiting examples of such N-terminal Sec-dependent secretion signals include PhoA, OmpF, OmpA, and cvaC. In alternate embodiments, the therapeutic polypeptide of interest is fused to a Tat-dependent secretion signal. Exemplary Tat-dependent tags include TorA, FdnG, and DmsA.

In certain embodiments, the genetically engineered bacteria comprise deletions or mutations in one or more of the outer membrane and/or periplasmic proteins. Non-limiting examples of such proteins, one or more of which may be deleted or mutated, include lpp, pal, tolA, and/or nlpI. In some embodiments, lpp is deleted or mutated. In some embodiments, pal is deleted or mutated. In some embodiments, tolA is deleted or mutated. In other embodiments, nlpI is deleted or mutated. In yet other embodiments, certain periplasmic proteases are deleted or mutated, e.g., to increase stability of the polypeptide in the periplasm. Non-limiting examples of such proteases include degP and ompT. In some embodiments, degP is deleted or mutated. In some embodiments, ompT is deleted or mutated. In some embodiments, degP and ompT are deleted or mutated.

In some embodiments, the therapeutic polypeptides of interest, e.g., IL-12, IL-2, IL-15, IL-18, IL-7, IL-21, CD40 agonist, CD40 agonist, CD226 agonist, CD137 agonist, ICOS agonist, OX040 agonist, GM-CSF, tryptophan and/or arginine synthesis enzymes, antibodies, e.g., scFvs, including but not limited to checkpoint inhibitors (e.g., PD1, PDL1, CTLA4, and others described herein, kynureninase, adenosing degradation enzymes, are secreted via a Type V Auto-secreter (pic Protein) Secretion. In some embodiments, the therapeutic protein of interest is expressed as a fusion protein with the native Nissle auto-secreter *E. coli*_01635 (where the original passenger protein is replaced with the therapeutic polypeptides of interest.

In some embodiments, the therapeutic polypeptides of interest, e.g., IL-12, IL-2, IL-15, IL-18, IL-7, IL-21, CD40 agonist, CD40 agonist, CD226 agonist, CD137 agonist, ICOS agonist, OX040 agonist, GM-CSF, tryptophan and/or argininine synthesis enzymes, antibodies, e.g., scFvs, including but not limited to checkpoint inhibitors (e.g., PD1, PDL1, CTLA4, anti-LAGS, anti-TIM3 and others described herein, kynureninase, adenosine degradation enzymes, are secreted via Type I Hemolysin Secretion. In one embodiment, therapeutic polypeptide of interest is expressed as fusion protein with the 53 amino acids of the C terminus of alpha-hemolysin (hlyA) of *E. coli* CFT073.

Surface Display

In some embodiments, the genetically engineered bacteria and/or microorganisms encode one or more gene(s) and/or gene cassette(s) encoding an anti-cancer molecule which is anchored or displayed on the surface of the bacteria and/or microorganisms. Examples of the anti-cancer molecules which are displayed or anchored to the bacteria and/or microorganism, are any of the anti-cancer molecules described herein, and include but are not limited to antibodies, e.g., scFv fragments, and tumor-specific antigens or neoantigens. In a non-limiting example, the antibodies or scFv fragments which are anchored or displayed on the bacterial cell surface are directed against checkpoint inhibitors described herein, including, but not limited to, CLTLA4, PD-1, PD-L1, and others described herein.

In some embodiments, the genetically engineered bacteria comprise one or more gene sequence(s) encoding therapeutic polypeptide or effector molecule, e.g., a ScFv, which is anchored or displayed on the surface of the bacteria, and which remains anchored while exerting its effector function. In other embodiments, the genetically engineered bacteria encoding the surface-displayed therapeutic polypeptide, e.g., the antibodies or scFv fragments, lyse before, during or after exerting their effector function. In some embodiments, the genetically engineered bacteria encode a therapeutic peptide that is temporarily attached to the cell surface and which dissociates from the bacterium before, during, or after exerting its function.

In some embodiments, shorter peptides or polypeptides, e.g. peptides or polypeptides of less than 60 amino acids of length, are displayed on the cell surface of the genetically engineered bacteria. In some embodiments, such shorter peptides or polypeptides comprise a immune modulatory effector molecule. Non-limiting examples of such therapeutic polypeptides are described herein.

Several strategies for the display of shorter peptides or polypeptides on the surface of gram negative bacteria are known in the art, and are for example described in Georgiou et al., Display of heterologous proteins on the surface of microorganisms: from the screening of combinatorial libraries to live recombinant vaccines: Nat Biotechnol. 1997 January; 15(1):29-34, the contents of which is herein incorporated by reference in its entirety. These systems all share a common theme, targeting recombinant proteins to the cell surface by the construction of gene fusions using sequences from membrane-anchoring domains of surface proteins.

Non-limiting examples of such strategies are described in Table 63A and Table 63B.

TABLE 63A

Exemplary Cell Surface Display Strategies

| Carrier protein | Exemplary carrier organism | Type of fusion | Localization of heterologous polypeptide |
| --- | --- | --- | --- |
| LamB | *E. coli* | Sandwich fusion | Cell surface |
| PhoE | *E. coli* | Sandwich fusion | Cell surface |
| OprF | *Pseudomonas* | Sandwich fusion | Cell surface |
| Gram negative lipoproteins | *E. coli* | C-terminal or sandwich fusion | Periplasmic side or outer membrane/Cell surface |
| Lpp-OmpA | *E. coli* | C-terminal fusion | Cell surface |
| VirG | *Shigella* | N-terminal fusion | Cell surface |
| IgA | *Neisseria* | N-terminal fusion | Cell surface |
| Flagellin (FliC) | *E. coli* | Sandwich fusion | Cell surface |
| Flagellin (FliC) | *E. coli* | Sandwich fusion | Cell surface |
| FimH (type I pili) | *E. coli* | Sandwich fusion | Cell surface |
| PapA (Pap pili) | *E. coli* | Sandwich fusion | Cell surface |
| PulA | *Klebsiella* | C-terminal fusion | Cell surface/extracellular fluid |

TABLE 63B

Exemplary Cell Surface Display Strategies

| Carrier | Passenger size |
| --- | --- |
| Outer membrane Proteins | |
| OmpA | 15-514 aa |
| OmprF | 17-43 aa |
| LamB | 11-232 aa |
| OmpS | 38-115 aa |
| OmpC | 162 aa |
| PhoE | 8-32 aa |
| Invasin | 18 aa |
| LppOmpA | < or = 40 kDa |
| Lipoproteins | |
| TraT | 11-98 aa |
| PAL | Approx.. 250 aa |
| OprI | 16 aa |
| Inp | Less than or equal 47 kDa |

TABLE 63B-continued

Exemplary Cell Surface Display Strategies

| Carrier | Passenger size |
|---|---|
| Autotransporters | |
| Igabeta | 12 kDa |
| VirGbeta | Approx.. 50 kDa |
| AIDA-1 | 12-40 kDa |
| Secreted | |
| Pullulanase | |
| Subunits of Surface Appendages | |
| Flagellae | 11-115 aa |
| Fimbriae | 7-52 aa |
| S-layer proteins | |
| RsaA | 12 aa |

TABLE 63C

Exemplary Cell Surface Strategies

| Outer membrane protein | Type of fusion | Passenger size (kDa) |
|---|---|---|
| Outer membrane protein | | |
| eCPX derived from OmpX | Biterminal | 0.8-1.6 |
| FhuA | Insertional | 1.1-3.3 |
| LamB | Insertional | 1.2-25.5 |
| Omp1 | C-terminal | 56 |
| OmpA | Insertional | 1-50 |
| OmpC | Insertional, C-terminal | 18-52 |
| OmpT | | 35 |
| OprF | C-terminal | 50 |
| Pgs A | C-terminal | 34-77 |
| Wza-omp orf1/OmpU/Omp26La | C-terminal | 27-50 |
| Surface Appendages | | |
| F Pillin | Insertional | 1.6 |
| Fimbria (FimH and FimA) | Insertional | 1-4 |
| Flagellin (FliC and FliD) | Insertional | 1.2-33 |
| Lipoproteins | | |
| INP | C-terminal | 7-119 |
| Lpp = OmpA | C-terminal | 27-74 |
| PAL | N-terminal | 29 |
| Tat-dependent lipoprotein | C-terminal | 27 |
| TraT | Insertional, C-terminal | 1.2-11 |
| Virulence Factors | | |
| AIDA-1 | N-terminal | 12-65 |
| EaeA | C-terminal | 3.9-31.6 |
| EspP | N-terminal | 20 |
| EstA | N-terminal | 38-60 |
| Invasin | C-terminal | 1.1 |
| MSP1a | N-terminal | 4.6 |

In some embodiments, the genetically engineered bacteria comprise one or more gene sequence(s) encoding one or more short therapeutic peptides or polypeptides fused into surface exposed loops of outer membrane proteins (OMPs), e.g., from enteric bacteria. In a non-limiting example, the short therapeutic peptides or polypeptides expressed by the genetically engineered bacteria are inserted into the outer membrane protein LamB, e.g., from E. coli, and displayed on the bacterial cell surface. Extracellular display of peptides through Insertion of peptides into surface exposed loops of LamB is for example described in Hofnung et al., Expression of foreign polypeptides at the Escherichia coli cell surface; Methods Cell Biol. 34:77-105, and Charbit, A. et al., 1987. Presentation of two epitopes of the preS2 region of hepatitis B virus on live recombinant bacteria, J. Immunol. 139:1658-1664.

In another non-limiting example, the short therapeutic peptides or polypeptides encoded by one or more gene sequence(s) comprised in the genetically engineered bacteria are inserted into the outer membrane protein PhoE, e.g., from E. coli, and displayed on the bacterial cell surface. The PhoE protein is another abundant outer membrane protein of E. coli K-12, which has a trimeric structure and functions as a pore for small molecules. Analysis of the primary structure of PhoE revealed 16 beta sheets which traverse through the membranes, and eight hypervariable regions exposed at the surface of the cell. One or more of these cell surface exposed regions of PhoE protein can be used to insert heterologous peptides. For example, antigenic determinants of pathogenic organisms have been presented in one or more cell surface exposed regions of PhoE protein (e.g., as described in Aterberg et al., 1990; Outer membrane PhoE protein of Escherichia coli as a carrier for foreign antigenic determinants: immunogenicity of epitopes of foot-and-mouth disease virus; Vaccine. 1990 February; 8(1):85-91).

In some embodiments, the genetically engineered bacteria comprise one or more gene sequence(s) encoding one or more short therapeutic peptides or polypeptides fused to protein components of extracellular appendages. Several systems have been described, in which extracellular appendages, such as pili and flagella are used to display peptides of interest at the bacterial cell surface. Examples of flagellar and pilar proteins used include FliC, a major structural component of the E. coli flagellum, and PapA, the major subunit of the Pap pilus. In one embodiment, the genetically engineered bacteria comprise one or more gene sequence(s) encoding one or more components of a FLITRX system. The FLITRX system is an E. coli display system based on the use of fusion protein of FliC and thioredoxin, a small redox protein which represents a highly versatile scaffold that allows peptide inserts to assume a confirmation compatible with binding to other proteins. In the FLITRX system, thioredoxin is fused into a dispensable region of FliC. Then, heterologous peptides can be inserted within the thioredoxin domain in the FliC fusion, and are surface exposed. Other scaffolding proteins are known in the art, some of which may replace thioredoxin as a scaffolding protein in this system.

In some embodiments, the genetically engineered bacteria comprise a FimH fusion protein, in which the therapeutic peptide of interest is fused to FimH, an adhesin of type 1 fimbriae, e.g., from E. coli. FimH adhesin chimeras containing as many as 56 foreign amino acids in certain positions are transported to the bacterial surface as components of the fimbrial organelles (Pallesen et al., Chimeric FimH adhesion of type I fimbriae: a bacterial surface display system for heterologous sequences. Microbiology 141: 2839-2848).

In some embodiments, the genetically engineered bacteria comprise one or more gene sequence(s) encoding a fusion protein in which the therapeutic peptide of interest is fused to the major subunit of F11 fimbriae, e.g., from E. coli. Hypervariable regions of the major subunit of F11 fimbriae can be used for insertion of heterologous peptides, e.g., antigenic epitopes (Van Die et al., Expression of foreign epitopes in P-fimbriae of Escherichia coli. Mol. Gen. Genet. 222: 297-303).

In one embodiment, the genetically engineered bacteria comprise one or more gene sequence(s) encoding a papA fusion protein, in which the therapeutic peptide of interest is fused to papA. In some embodiments, peptides of interest are inserted following either codon 7 or 68 of the coding sequence for the mature portion of PapA, as peptides in the area of amino acids 7 and 68 of PapA are localized at the external side of the pilus (Steidler et al., Pap pili as a vector system for surface exposition of an immunoglobulin G-binding domain of protein A of *Staphylococcus aureus* in *Escherichia coli*; J Bacteriol. 1993 December; 175(23): 7639-43).

In some embodiments, the genetically engineered bacteria comprise one or more gene sequence(s), which encode polypeptides larger than 60 amino acids, e.g., immune modulatory effector, and which are displayed on the bacterial cell surface. In some embodiments, the genetically engineered bacteria comprise one or more gene sequence(s), which encode a fusion protein, in which a therapeutic peptide of interest, e.g., a polypeptide greater than 60 amino acids in length, is fused to a lipoprotein from a gram negative bacterium, or one or more fragments thereof.

In one embodiment, the genetically engineered bacteria comprise one or more gene sequence(s), which encode a fusion protein, in which a therapeutic protein of interest is fused to peptidoglycan associated lipoprotein (PAL) or a fragment thereof. The fusion protein in located in the periplasm and can be displayed externally upon permeabilization of the outer membrane. For example, a PAL-scFv fusion protein was shown to bind its antigen and to be tightly bound to the murein layer of the cell envelope (Fuchs et al., Targeting recombinant antibodies to the surface of *Escherichia coli* fusion to a peptidoglycan-associated lipoprotein; Biotechnology (N Y). 1991 December; 9(12):1369-72). The PAL-scFv fusion was located in the periplasm and bound to the murein layer, and after permeabilization of the outer membrane, the scFv became accessible to externally added antigen. In some embodiments, the genetically engineered bacteria comprising a fusion protein for surface display further have a permeable outer membrane. Mutations and/or deletions resulting in a leaky outer membrane are described elsewhere herein.

In one embodiment, the genetically engineered bacteria encode a fusion protein, in which a therapeutic protein of interest, e.g., a immune modulatory effector, is fused to 5 residues of the major lipoprotein of a gram negative bacterium, e.g., *E. coli*. In one embodiment, the genetically engineered bacteria encode a fusion protein, in which a therapeutic protein of interest, is fused to the signal peptide and the nine N-terminal amino acid residues of the major lipoprotein of a gram negative bacterium, e.g., *E. coli*. These residues of the *E. coli* major lipoprotein function as a hydrophobic membrane anchor. For example, a fusion construct of these residues with a therapeutic polypeptide, in this case a scFv fragment, resulted in specific accumulation of an immunoreactive and cell-bound polypeptide in *E. coli* (Laukkanen et al., Lipid-tagged antibodies: bacterial expression and characterization of a lipoprotein-single-chain antibody fusion protein. Mol. Microbiol. 4:1259-1268).

In one embodiment, the genetically engineered bacteria encode a fusion protein, in which a therapeutic protein of interest, is inserted into the TraT protein of a gram negative bacterium, e.g., *E. coli*, e.g. at position 180. The TraT protein is a surface-exposed lipoprotein, specified by plasmids of the IncF group, that mediates serum resistance and surface exclusion. Taylor et al. showed that insertion of the C3 epitope of polio virus, e.g., at position 180, allowed exposure of the antigen to the cell surface, while the oligomeric conformation of the wild-type protein was maintained (Taylor et al., The TraT lipoprotein as a vehicle for the transport of foreign antigenic determinants to the cell surface of *Escherichia coli* K12: structure-function relationship in the TraT protein. Mol Microbiol. 1990 August; 4(8):1259-68).

In one embodiment, the genetically engineered bacteria comprise one or more genes and/or gene cassettes encoding a fusion protein comprising a Lpp-OmpA display vehicle comprising the N terminal outer membrane signal from the major lipoprotein (Lpp) fused to a domain from the outer membrane protein OmpA, fused to the therapeutic polypeptide of interest. In this system, the Lpp signal peptide mediates localization, and OmpA provides the framework for the display of the therapeutic protein of interest. Lpp-OmpA fusions have been used to display several proteins between 20 and 54 kDa in size on the surface of *E. coli* (see, e.g., Staphopoulos et al., Characterization of *Escherichia coli* expressing and Lpp-OpmA (46-159)-PhoA fusion protein localized in the outer membrane). For example, Fransco et al fused beta -lactamase to the N-terminal targeting sequence of Lpp and an OmpA fragment containing 5 of the 8 membrane spanning loops of the native protein. This fusion protein was assembled on the cell surface and the beta-lactamase domain was stably anchored in the cell wall (Fransisco et al., Transport and anchoring of beta-lactamase to the external surface of *Escherichia coli*; Proc. Natl. Acad. Sci. USA Vol 89, pp. 2713-2717, 1992).

In one embodiment, the Type II secretion pathway or a variation thereof is used to for transient or longer duration display of therapeutic proteins of interest on the bacterial cell surface, e.g., the IgA protease secretion pathway of *Neisseria* or the VirG protein pathway of *Shigella*. In one embodiment, the IgA protease secretion pathway is used to export and display therapeutic peptides of interest on the cell surface of gram negative bacteria. The IgA proteases of *Neisseria gonorrhoeae* and Hemophilus influenza use a variation of the most common, Type II secretion pathway, to achieve extracellular export independent of any other gene products. The IgA genes of *Neisseria* species encode extracellular proteins that cleave human IgA1 antibody. The iga gene alone is sufficient to direct selected extracellular secretion of IgA protease in *Neisseria, Salmonella*, and *E. coli* species (Klauser et al., 1993, Extracellular transport of cholera toxin B subunit using *Neisseria* IgA protease beta-domain: conformation-dependent outer membrane translocation. EMBO J 9:1991-1999, and references therein). The mature IgA protease is processed in several steps from a large precursor by signal peptidase and autoproteolytic cleavage. The precursor consists of four domains: (1) an aminoterminal signal peptide which mediates inner membrane transport; (2) the protease domain (3) the alpha domain, a basic alpha helical region which is secreted with the protease and (4) the autotransporter beta domain which harbors the essential function for outer membrane transport. Essentially, the C-terminal beta autotransporter domain of the IgA protease forms a channel in the outer membrane that mediates the export of the N terminal domain across the membrane, which in turn becomes transiently displayed on the external surface of the bacteria. The alpha domain and protease domain are then released through proteolytic cleavage. Klauser et al. (1993), showed that replacement of the native N-terminal domains of IgA protease of *N. gonorrhoeae* with the cholera toxin B resulted in the surface presentation of the passenger polypeptide in *S. typhymurium*. In another study, the signal sequence and the C-terminal beta autotransporter domain of the IgA protease of

*Neisseria gonorrhoeae* was used to translocate and display a scFv directed against a porcine epidemic diarrhea virus epitope on the bacterial cell surface of *E. coli* (Pyo et al., *Escherichia coli* expressing single chain Fv on the cell surface as a potential prophylactic of porcine epidemic diarrhea virus; Vaccine (27) (2009) 2030-2036.).

Thus, in one embodiment, the genetically engineered bacteria encode a IgA protease fragment in which the alpha domain is substituted with a therapeutic protein of interest, and fused to a functional IgA protease beta-domain, which mediates export through the outer membrane. Without wishing to be bound by theory, IgA protease activity is eliminated in such a fusion protein, and therefore the autoproteoulytic release of the fusion protein into the medium does not occur, resulting in the display of the therapeutic protein of interest on the cell surface of the gram-negative host bacterium.

The secretion of VirG protein from *Shigella* is similar to the export system utilized by the IgA protease of *Neisseria* (see, e.g., Suzuki et al., 1995; Extracellular transport of VirG protein in *Shigella* J Biol. Chem 270:30874-30880, and references therein). Thus, in some embodiments, the genetically engineered bacteria encode a fusion protein comprising a therapeutic protein of interest fused to the membrane spanning region of VirG, resulting in surface display of the therapeutic protein of interest. The VirG gene on the large plasmid of *Shigella* has been shown to be responsible for the localized deposition of filamentous actin (F-actin) trailing from one pole of invading bacterial cells and extending in a filament through the host epithelial cytoplasm. VirG is a surface-exposed outer membrane protein consisting of three distinctive domains, the N-terminal signal sequence (amino acids 1-52), the id α-domain (amino acids 53-758), and the dC-terminal β-core (amino acids 759-1102) (see, e.g., Suzuki et al., 1996; Functional Analysis of *Shigella* VirG Domains Essential for Interaction with Vinculin and Actin-based Motility; J. Biol. Chem., 271, 21878-21885, and references therein). Suzuki et al. (1995); showed that the fusion of a foreign protein such as MalE or PhoA protein to the N terminus 37-kDa VirG portion resulted in the transport of the passenger polypeptides from the periplasm to the external side of the outer membrane, indicating that the C-terminal 37-kDa VirG portion embedded in the outer membrane is involved in the translocation of the preceding VirG portion or the heterologous or passenger polypeptide from the periplasmic space to the external side of the outer membrane, in a manner homologous to the IgA protease beta-domain. In some embodiments, the genetically engineered bacteria comprise one or more gene(s) or gene cassette(s) encoding a fusion protein, in which a C-terminal 37-kDa VirG protein fragment is fused to a therapeutic protein of interest.

In some embodiments, the genetically engineered bacteria comprise one or more gene(s) or gene cassette(s) encoding a fusion protein, in which a therapeutic protein of interest is fused to pullulanase for temporary surface display. Pullulanase is specifically released into the medium by *Klebsiella pneumonieae*, and exists as a fully exposed, cell surface-bound intermediate before it is released into the medium from early stationary growth phase onwards. Cell-surface anchoring is accomplished by an N-terminal fatty acyl modification whose chemical composition is identical to that of other bacterial protein.

Unlike the IgA protease, the lipoprotein pullulanase (PulA) of *Klebsiella pneumoniae*, which is also exported via a type II secretion mechanism, requires 14 genes for its translocation across the outer membrane. For example, Pugsley and coworkers have shown that the lipoprotein pullulanase (PulA) can facilitate translocation of the periplasmic enzyme beta-lactamase across the outer membrane. In particular, in *E. coli* strains expressing all pullulanase secretion genes, pullulanase-beta-lactamase hybrid protein molecules containing an N-terminal 834-amino-acid pullulanase segment were efficiently transported to the cell surface. Of note, pullulanase hybrids remain only temporarily attached to the bacterial surface and are subsequently released into the medium (Kornacker and Pugsley: The normally periplasmic enzyme beta-lactamase is specifically and efficiently translocated through the *Escherichia coli* outer membrane when it is fused to the cell surface enzyme pullulanase. Mol. Microbiol. 4:1101-1109, and references therein). Accordingly, in some embodiments, the genetically engineered bacteria comprise one or more gene sequence(s) comprising a complete set of pullulanase genes required for secretion and fusion protein comprising a therapeutic protein of interest fused to a N-terminal pullulanase polypeptide fragment, e.g., as described by Kornacker and Pugsley. In some embodiments, the fusion proteins comprising N-terminal pullulanase polypeptide fused to the therapeutic protein of interest, are transiently displayed on the surface of the bacterial cell, and subsequently released into the media or extracellular space.

In one embodiment, the genetically engineered bacteria comprise one or more gene(s) or gene cassette(s) encoding a fusion protein in which the ice nucleation protein (INP) from *Pseudomonas syringae* anchors a therapeutic protein of interest in the cell wall. INP is a secretory protein that catalyzes extracellular ice formation as the ice nuclei. INP has been found in a number of Gram-negative species, including *P. syringae, Erwinia herbicola, Xanthomonas campestris*, and *Pseudomonas fluorescens*. Four genes in *P. syringae* strains, inaK, inaV, and inaZ, and inaQ exhibit high similarities in sequences and in primary organization (Li et al., Molecular Characterization of an Ice Nucleation Protein Variant (InaQ) from *Pseudomonas syringae* and the Analysis of Its Transmembrane Transport Activity in *Escherichia coli* Int J Biol Sci. 2012; 8(8): 1097-1108). All INPs (1200 aa to 1500 aa) comprise of three distinct structural domains: (1) the N-terminal domain (approximately 15% of the total sequence), which is relatively hydrophobic and which is are potentially capable of being coupled to the mannan-phosphatidylinositol group in the outer membrane through N-glycan (Asp) or O-glycan (Ser, Thr) linkages; (2) the C-terminal domain (approximately 4%), which is a relatively hydrophilic terminus; and (3) the central repeating domain (CRD) (approximately 81%), which constitutes contiguous repeats given by 16-residue (or 48-residue) periodicities with a consensus octapeptide (Ala-Gly-Tyr-Gly-Ser-Thr-Leu-Thr). INPs have been employed in various bacterial cell-surface display systems including *E. coli, Zymomonas mobilis*, Salmonellas sp., *Vibrio* anguillarum, *Pseudomonas putida*, and cyanobacteria, in all od which INPs were able to target a heterologous protein onto the surface of the host cell. Moreover, the N-terminal region alone was shown to direct translocation of foreign proteins to the cell surface and can be employed as a potential cell surface display motif (Li et al., 2004 Functional display of foreign protein on surface of *Escherichia coli* using N-terminal domain of ice nucleation protein; Biotechnol Bioeng. 2004 Jan. 20; 85(2):214-21). Accordingly, in some embodiments, the genetically engineered bacteria comprise IMP fusions for surface display of a therapeutic peptide of interest. In some embodiments the N-terminal region of the INP protein is fused to the polypeptide of interest for surface display.

IMP proteins further have modifiable internal repeating units, ie., CRD length is adjustable, which is allows flexibility in protein fusion length (Jung et al., 1998), and also can accommodate larger polypeptides. For example, the INP-based display systems were used to successfully express a 90 kDA protein on the cell surface of *E. coli* (Wu et al., 2006; Cell surface display of Chi92 on *Escherichia coli* using ice nucleation protein for improved catalytic and antifungal activity; FEMS Bicrobiology Letters, Volume 256, Issue 1; Pages 119-125).

It is understood by those skilled in the art that translocation of such fusion or hybrid proteins described herein requires a "translocation-competent" conformation, e.g., the formation of disulfide bonds, e.g., in the periplasmic space, may be undesirable and inhibit translocation through the outer membrane (see, e.g., Klauser et al., 1990), or alternatively may be required for, (or at least not impede) translocation through the outer membrane (see, e.g., Puggsley, 1992; Translocation of a folded protein across the outer membrane in *Escherichia coli*; Proc Natl Acad Sci USA. 1992 Dec. 15; 89(24): 12058-12062). In some embodiments, the genetically engineered bacteria comprise one or more gene sequence(s) encoding for a fusion protein in which disulfide bonds are prevented from forming prior to the translocation to the cell surface. In some embodiments, the genetically engineered bacteria comprise one or more gene(s) or gene cassette(s) encoding for a fusion protein in which disulfide bonds are formed prior to translocation to the cell surface.

Expression systems for the display of proteins in Gram-positive bacteria have also been developed. Consequently, in some embodiments, gram positive bacteria are engineered to display therapeutic proteins of interest on their cell surface. Uhlen et al. used fusions to the cell-wall bound, X-domain of protein A, for the display of foreign peptides up to 88 amino acids long to the surface of *Staphylococcus* strains. For example one study describes an expression system to allow targeting of heterologous proteins to the cell surface of *Staphylococcus xylosus*, a coagulase-negative gram-positive bacterium (Hansson et al., Expression of recombinant proteins on the surface of the coagulase-negative bacterium *Staphylococcus xylosus*; J Bacteriol. 1992 July; 174(13): 4239-45).

The expression of recombinant gene fragments, fused between gene fragments encoding the signal peptide and the cell surface-binding regions of staphylococcal protein A, targets the resulting fusion proteins to the outer bacterial cell surface via the membrane-anchoring region and the highly charged cell wall-spanning region of staphylococcal protein A. Accordingly, in some embodiments, the genetically engineered bacteria comprise one or more gene sequences encoding a therapeutic polypeptide fused between gene fragments encoding the signal peptide and the cell surface-binding regions of staphylococcal protein A

*E. coli*-staphylococcus shuttle vectors have been constructed by taking advantage of the promoter, signal sequence, and propeptide region from the lipase gene construct derived from *S. hyicus* and the cell surface attachment part of staphylococcal protein A. This system has been investigated for the surface display of heterologous polypeptides on *S. carnosus* (Samuelson et al., Cell surface display of recombinant proteins on *Staphylococcus carnosus*; J Bacteriol. 1995 March; 177(6):1470-6). In some embodiments, the genetically engineered bacteria comprise one or more gene sequence(s) encoding a therapeutic polypeptide fusion protein comprising promoter, signal sequence, and propeptide region from the lipase gene construct derived from *S. hyicus* and the cell surface attachment part of staphylococcal protein A.

In other studies, the fibrillary M6 proteins of *Streptococcus pyrogenes* was employed as a carrier for antigen delivery in *Streptococcus* cells. (Pozzi et al., 1992; Delivery and expression of a heterologous antigen on the surface of streptococci. Infect. Immunm. 60: 1902-1907). In some embodiments, the genetically engineered bacteria comprise one or more gene sequence(s) comprising therapeutic polypeptide fusion proteins comprising the fibrillary M6 proteins of *Streptococcus* pyrogenes for cell surface display of the therapeutic polypeptide.

In some embodiments, the genetically engineered bacteria comprise one or more gene(s) or gene cassette(s) encoding a polypeptide of interest which is displayed on the cell surface through a fusion with an intimin or invasin. Intimins and invasins belong to a family of bacterial adhesins which specifically interact with various eukaryotic cell surface receptors, thereby mediating bacterial adherence and invasion. Both intimins and invasins provide a structural scaffold ideally suited to the cell surface display.

In some embodiments, the genetically engineered bacteria comprise one or more gene(s) or gene cassette(s) encoding a polypeptide of interest which is displayed on the cell surface through a fusion with an intimin, e.g., with the Enterohemorragic *E. coli* Intimin EaeA protein or a carboxy-terminal truncation thereof (e.g., as described in Wentzel et al, Display of Passenger Proteins on the Surface of *Escherichia coli* K-12 by the Enterohemorrhagic *E. coli* Intimin EaeA J Bacteriol. 2001 December; 183(24): 7273-7284). For example, N-terminal 489 amino acids of invasin are sufficient to promote the localization of a fusion protein to the cell surface.

In some embodiments, the genetically engineered bacteria comprise one or more gene(s) or gene cassette(s) encoding a polypeptide of interest which is displayed on the cell surface through a fusion with an invasin, e.g. Enterohemorrhagic *E. coli* invasion, or a carboxyterminal truncation thereof. For example, N-terminal 539 amino acids of intimin were sufficient to promote outer membrane localization of a fusion protein (Liu et al., The Tir-binding region of enterohemorrhagic *Escherichia coli* intimin is sufficient to trigger actin condensation after bacterial-induced host cell signaling; Mol Microbiol. 1999 October; 34(1):67-81).

In some embodiments, the genetically engineered bacteria comprise one or more gene(s) or gene cassette(s) encoding a polypeptide of interest which is displayed on the cell surface through a fusion with *Bacillus anthracis* exosporal protein (Bc1A) as an anchoring motif. The Bc1A is an exosporium protein, a hair-like protein surrounding the *B. anthracis* spore. In a nonlimiting example, a polypeptide of interest is linked to the C-terminus of N-terminal domain (21 amino acids) of Bc1A, e.g., as described in Park et al. (Surface display of recombinant proteins on *Escherichia coli* by Bc1A exosporium of *Bacillus anthracis*).

Various other anchoring motifs have been developed including OprF, OmpC, and OmpX. In some embodiments, the genetically engineered bacteria comprise one or more gene(s) or gene cassette(s) encoding a polypeptide of interest which is displayed on the cell surface through a fusion with OprF, OmpC, and OmpX.

In some embodiments, the therapeutic polypeptides of interest are permanently displayed on the cell surface of the genetically engineered bacterium. In some embodiments, the therapeutic polypeptides of interest are transiently displayed on the cell surface of the genetically engineered bacterium.

In some embodiments, the therapeutic polypeptides are displayed in strains, e.g., described herein which display a leaky phenotype. Such strains have deactivating mutations in one or more of genes encoding a protein that tethers the outer membrane to the peptidoglycan skeleton, e.g., lpp, ompC, ompA, ompF, tolA, tolB, pal, and/or one or more genes encoding a periplasmic protease, e.g., degS, degP, nlpI.

In some embodiments, one or more ScFvs are displayed on the bacterial cell surface, alone or in combination with other therapeutic polypeptides of interest.

In some embodiments, a cell surface display strategy or circuit is combined with a secretion strategy or circuit in one bacterium. In some embodiments, the same polypeptide is both displayed and secreted. In some embodiments, a first polypeptide is displayed and a second is secreted. In some embodiments, a display strategy or circuit strategy is combined with a circuit for the intracellular production of an enzyme and consequentially intracellular catabolism of its substrate. In some embodiments, a display strategy or display circuit is combined with a circuit for the intracellular production of a gut barrier enhancer molecule and/or an anti-inflammatory effector molecule.

In some embodiments, the expression of the surface displayed polypeptide or fusion protein is driven by an inducible promoter. In some embodiments, the inducible promoter is an oxygen level-dependent promoter (e.g., FNR-inducible promoter). In some embodiments, the inducible promoter is induced by gut-specific and/or tumor-specific or promoters induced by inflammation or an inflammatory response (RNS, ROS promoters), or promoters induced by a metabolite that may or may not be naturally present (e.g., can be exogenously added) in the gut, e.g., arabinose. In alternate embodiments, expression of the surface displayed polypeptides or polypeptide fusion proteins is driven by a constitutive promoter.

In some embodiments, the expression of the surface displayed polypeptide or fusion protein is plasmid based. In some embodiments, the gene sequence(s) encoding the antibodies or scFv fragments for surface display is chromosomally inserted.

Essential Genes and Auxotrophs

As used herein, the term "essential gene" refers to a gene that is necessary to for cell growth and/or survival. Bacterial essential genes are well known to one of ordinary skill in the art, and can be identified by directed deletion of genes and/or random mutagenesis and screening (see, for example, Zhang and Lin, 2009, DEG 5.0, a database of essential genes in both prokaryotes and eukaryotes, Nucl. Acids Res., 37:D455-D458 and Gerdes et al., Essential genes on metabolic maps, Curr. Opin. Biotechnol., 17(5):448-456, the entire contents of each of which are expressly incorporated herein by reference).

An "essential gene" may be dependent on the circumstances and environment in which an organism lives. For example, a mutation of, modification of, or excision of an essential gene may result in the recombinant bacteria of the disclosure becoming an auxotroph. An auxotrophic modification is intended to cause bacteria to die in the absence of an exogenously added nutrient essential for survival or growth because they lack the gene(s) necessary to produce that essential nutrient.

An auxotrophic modification is intended to cause bacteria to die in the absence of an exogenously added nutrient essential for survival or growth because they lack the gene(s) necessary to produce that essential nutrient. In some embodiments, any of the genetically engineered bacteria described herein also comprise a deletion or mutation in a gene required for cell survival and/or growth. In one embodiment, the essential gene is a DNA synthesis gene, for example, thyA. In another embodiment, the essential gene is a cell wall synthesis gene, for example, dapA. In yet another embodiment, the essential gene is an amino acid gene, for example, serA or MetA. Any gene required for cell survival and/or growth may be targeted, including but not limited to, cysE, glnA, ilvD, leuB, lysA, serA, metA, glyA, hisB, ilvA, pheA, proA, thrC, trpC, tyrA, thyA, uraA, dapA, dapB, dapD, dapE, dapF, flhD, metB, metC, proAB, and thi1, as long as the corresponding wild-type gene product is not produced in the bacteria.

Table 64 lists exemplary bacterial genes which may be disrupted or deleted to produce an auxotrophic strain. These include, but are not limited to, genes required for oligonucleotide synthesis, amino acid synthesis, and cell wall synthesis.

TABLE 64

Non-limiting Examples of Bacterial Genes Useful for Generation of an Auxotroph

| Amino Acid | Oligonucleotide | Cell Wall |
|---|---|---|
| cysE | thyA | dapA |
| glnA | uraA | dapB |
| ilvD | | dapD |
| leuB | | dapE |
| lysA | | dapF |
| serA | | |
| metA | | |
| glyA | | |
| hisB | | |
| ilvA | | |
| pheA | | |
| proA | | |
| thrC | | |
| trpC | | |
| tyrA | | |

Table 65 shows the survival of various amino acid auxotrophs in the mouse gut, as detected 24 hrs and 48 hrs post-gavage. These auxotrophs were generated using BW25113, a non-Nissle strain of E. coli.

TABLE 65

Survival of amino acid auxotrophs in the mouse gut

| Gene | AA Auxotroph | Pre-Gavage | 24 hours | 48 hours |
|---|---|---|---|---|
| argA | Arginine | Present | Present | Absent |
| cysE | Cysteine | Present | Present | Absent |
| glnA | Glutamine | Present | Present | Absent |
| glyA | Glycine | Present | Present | Absent |
| hisB | Histidine | Present | Present | Present |
| ilvA | Isoleucine | Present | Present | Absent |
| leuB | Leucine | Present | Present | Absent |
| lysA | Lysine | Present | Present | Absent |
| metA | Methionine | Present | Present | Present |
| pheA | Phenylalanine | Present | Present | Present |
| proA | Proline | Present | Present | Absent |
| serA | Serine | Present | Present | Present |
| thrC | Threonine | Present | Present | Present |
| trpC | Tryptophan | Present | Present | Present |
| tyrA | Tyrosine | Present | Present | Present |

TABLE 65-continued

Survival of amino acid auxotrophs in the mouse gut

| Gene | AA Auxotroph | Pre-Gavage | 24 hours | 48 hours |
|---|---|---|---|---|
| ilvD | Valine/Isoleucine/Leucine | Present | Present | Absent |
| thyA | Thiamine | Present | Absent | Absent |
| uraA | Uracil | Present | Absent | Absent |
| flhD | FlhD | Present | Present | Present |

For example, thymine is a nucleic acid that is required for bacterial cell growth; in its absence, bacteria undergo cell death. The thyA gene encodes thymidylate synthetase, an enzyme that catalyzes the first step in thymine synthesis by converting dUMP to dTMP (Sat et al., 2003). In some embodiments, the bacterial cell of the disclosure is a thyA auxotroph in which the thyA gene is deleted and/or replaced with an unrelated gene. Δ thyA auxotroph can grow only when sufficient amounts of thymine are present, e.g., by adding thymine to growth media in vitro. Without sufficient amounts of thymine, the thyA auxotroph dies. In some embodiments, the auxotrophic modification is used to ensure that the bacterial cell does not survive in the absence of the auxotrophic gene product, e.g., outside of the hypoxic tumor environment.

Diaminopimelic acid (DAP) is an amino acid synthesized within the lysine biosynthetic pathway and is required for bacterial cell wall growth (Meadow et al., 1959; Clarkson et al., 1971). In some embodiments, any of the genetically engineered bacteria described herein is a dapD auxotroph in which the dapD gene is deleted and/or replaced with an unrelated gene. A dapD auxotroph can grow only when sufficient amounts of DAP are present, e.g., by adding DAP to growth media in vitro. Without sufficient amounts of DAP, the dapD auxotroph dies. In some embodiments, the auxotrophic modification is used to ensure that the bacterial cell does not survive in the absence of the auxotrophic gene product.

In other embodiments, the genetically engineered bacterium of the present disclosure is a uraA auxotroph in which the uraA gene is deleted and/or replaced with an unrelated gene. The uraA gene codes for UraA, a membrane-bound transporter that facilitates the uptake and subsequent metabolism of the pyrimidine uracil (Andersen et al., 1995). A uraA auxotroph can grow only when sufficient amounts of uracil are present, e.g., by adding uracil to growth media in vitro. Without sufficient amounts of uracil, the uraA auxotroph dies. In some embodiments, auxotrophic modifications are used to ensure that the bacteria do not survive in the absence of the auxotrophic gene product.

In complex communities, it is possible for bacteria to share DNA. In very rare circumstances, an auxotrophic bacterial strain may receive DNA from a non-auxotrophic strain, which repairs the genomic deletion and permanently rescues the auxotroph. Therefore, engineering a bacterial strain with more than one auxotroph may greatly decrease the probability that DNA transfer will occur enough times to rescue the auxotrophy. In some embodiments, the genetically engineered bacteria of the invention comprise a deletion or mutation in two or more genes required for cell survival and/or growth.

Other examples of essential genes include, but are not limited to yhbV, yagG, hemB, secD, secF, ribD, ribE, thiL, dxs, ispA, dnaX, adk, hemH, lpxH, cysS, fold, rplT, infC, thrS, nadE, gapA, yeaZ, aspS, argS, pgsA, yefM, metG, folE, yejM, gyrA, nrdA, nrdB, folC, accD, fabB, gltX, ligA, zipA, dapE, dapA, der, hisS, ispG, suhB, tadA, acpS, era, rnc, ftsB, eno, pyrG, chpR, lgt, fbaA, pgk, yqgD, metK, yqgF, plsC, ygiT, pare, ribB, cca, ygjD, tdcF, yraL, yihA, ftsN, murl, murB, birA, secE, nusG, rplJ, rplL, rpoB, rpoC, ubiA, plsB, lexA, dnaB, ssb, alsK, groS, psd, orn, yjeE, rpsR, chpS, ppa, valS, yjgP, yjgQ, dnaC, ribF, lspA, ispH, dapB, folA, imp, yabQ, ftsL, ftsl, murE, murF, mraY, murD, ftsW, murG, murC, ftsQ, ftsA, ftsZ, lpxC, secM, secA, can, folK, hemL, yadR, dapD, map, rpsB, infB, nusA, ftsH, obgE, rpmA, rplU, ispB, murA, yrbB, yrbK, yhbN, rpsl, rplM, degS, mreD, mreC, mreB, accB, accC, yrdC, def first, rplQ, rpoA, rpsD, rpsK, rpsM, entD, mrdB, mrdA, nadD, hlepB, rpoE, pssA, yfiO, rplS, trmD, rpsP, ffh, grpE, yfjB, csrA, ispF, ispD, rplW, rplD, rplC, rpsJ, fusA, rpsG, rpsL, trpS, yrfF, asd, rpoH, ftsX, ftsE, ftsY, frr, dxr, ispU, rfaK, kdtA, coaD, rpmB, dfp, dut, gmk, spot, gyrB, dnaN, dnaA, rpmH, rnpA, yidC, tnaB, glmS, glmU, wzyE, hemp, hemC, yigP, ubiB, ubiD, hemG, secY, rplO, rpmD, rpsE, rplR, rplF, rpsH, rpsN, rplE, rplX, rplN, rpsQ, rpmC, rplP, rpsC, rplV, rpsS, rplB, cdsA, yaeL, yaeT, lpxD, fabZ, lpxA, lpxB, dnaE, accA, tilS, proS, yafF, tsf, pyrH, olA, rlpB, leuS, lnt, glnS, fldA, cydA, infA, cydC, ftsK, lolA, serS, rpsA, msbA, lpxK, kdsB, mukF, mukE, mukB, asnS, fabA, mviN, rne, yceQ, fabD, fabG, acpP, tmk, holB, lolC, lolD, lolE, purB, ymfK, minE, mind, pth, rsA, ispE, lolB, hemA, prfA, prmC, kdsA, topA, ribA, fabI, racR, dicA, ydfB, tyrS, ribC, ydiL, pheT, pheS, yhhQ, bcsB, glyQ, yibJ, and gpsA. Other essential genes are known to those of ordinary skill in the art.

In some embodiments, the genetically engineered bacterium of the present disclosure is a synthetic ligand-dependent essential gene (SLiDE) bacterial cell. SLiDE bacterial cells are synthetic auxotrophs with a mutation in one or more essential genes that only grow in the presence of a particular ligand (see Lopez and Anderson "Synthetic Auxotrophs with Ligand-Dependent Essential Genes for a BL21 (DE3 Biosafety Strain," ACS Synthetic Biology (2015) DOI: 10.1021/acssynbio.5b00085, the entire contents of which are expressly incorporated herein by reference).

In some embodiments, the SLiDE bacterial cell comprises a mutation in an essential gene. In some embodiments, the essential gene is selected from the group consisting of pheS, dnaN, tyrS, metG, and adk. In some embodiments, the essential gene is dnaN comprising one or more of the following mutations: H191N, R240C, I317S, F319V, L340T, V347I, and S345C. In some embodiments, the essential gene is dnaN comprising the mutations H191N, R240C, I317S, F319V, L340T, V347I, and S345C. In some embodiments, the essential gene is pheS comprising one or more of the following mutations: F125G, P183T, P184A, R186A, and I188L. In some embodiments, the essential gene is pheS comprising the mutations F125G, P183T, P184A, R186A, and I188L. In some embodiments, the essential gene is tyrS comprising one or more of the following mutations: L36V, C38A, and F40G. In some embodiments, the essential gene is tyrS comprising the mutations L36V, C38A, and F40G. In some embodiments, the essential gene is metG comprising one or more of the following mutations: E45Q, N47R, I49G, and A51C. In some embodiments, the essential gene is metG comprising the mutations E45Q, N47R, I49G, and A51C. In some embodiments, the essential gene is adk comprising one or more of the following mutations: I4L, L5I, and L6G. In some embodiments, the essential gene is adk comprising the mutations I4L, L5I, and L6G.

In some embodiments, the genetically engineered bacterium is complemented by a ligand. In some embodiments, the ligand is selected from the group consisting of benzothiazole, indole, 2-aminobenzothiazole, indole-3-butyric acid, indole-3-acetic acid, and L-histidine methyl ester. For example, bacterial cells comprising mutations in metG (E45Q, N47R, I49G, and A51C) are complemented by benzothiazole, indole, 2-aminobenzothiazole, indole-3-butyric acid, indole-3-acetic acid or L-histidine methyl ester. Bacterial cells comprising mutations in dnaN (H191N, R240C, I317S, F319V, L340T, V347I, and S345C) are complemented by benzothiazole, indole or 2-aminobenzothiazole. Bacterial cells comprising mutations in pheS (F125G, P183T, P184A, R186A, and I188L) are complemented by benzothiazole or 2-aminobenzothiazole. Bacterial cells comprising mutations in tyrS (L36V, C38A, and F40G) are complemented by benzothiazole or 2-aminobenzothiazole. Bacterial cells comprising mutations in adk (I4L, L5I, and L6G) are complemented by benzothiazole or indole.

In some embodiments, the genetically engineered bacterium comprises more than one mutant essential gene that renders it auxotrophic to a ligand. In some embodiments, the bacterial cell comprises mutations in two essential genes. For example, in some embodiments, the bacterial cell comprises mutations in tyrS (L36V, C38A, and F40G) and metG (E45Q, N47R, I49G, and A51C). In other embodiments, the bacterial cell comprises mutations in three essential genes. For example, in some embodiments, the bacterial cell comprises mutations in tyrS (L36V, C38A, and F40G), metG (E45Q, N47R, I49G, and A51C), and pheS (F125G, P183T, P184A, R186A, and I188L).

In some embodiments, the genetically engineered bacterium is a conditional auxotroph whose essential gene(s) is replaced using the arabinose system shown in the Figures.

In some embodiments, the genetically engineered bacterium of the disclosure is an auxotroph and also comprises kill switch circuitry, such as any of the kill switch components and systems described herein. For example, the recombinant bacteria may comprise a deletion or mutation in an essential gene required for cell survival and/or growth, for example, in a DNA synthesis gene, for example, thyA, cell wall synthesis gene, for example, dapA and/or an amino acid gene, for example, serA or MetA and may also comprise a toxin gene that is regulated by one or more transcriptional activators that are expressed in response to an environmental condition(s) and/or signal(s) (such as low oxygen levels) or regulated by one or more recombinases that are expressed upon sensing an exogenous environmental condition(s) and/or signal(s) (such as the recombinase systems described herein). Other embodiments are described in Wright et al., "GeneGuard: A Modular Plasmid System Designed for Biosafety," ACS Synthetic Biology (2015) 4: 307-16, the entire contents of which are expressly incorporated herein by reference). In some embodiments, the genetically engineered bacterium of the disclosure is an auxotroph and also comprises kill switch circuitry, such as any of the kill switch components and systems described herein, as well as another biosecurity system, such a conditional origin of replication (see Wright et al., supra).

In one embodiment, a genetically engineered bacterium, comprises one or more biosafety constructs integrated into the bacterial chromosome in combination with one or more biosafety plasmid(s). In some embodiments, the plasmid comprises a conditional origin of replication (COR), for which the plasmid replication initiator protein is provided in trans, i.e., is encoded by the chromosomally integrated biosafety construct. In some embodiments, the chromosomally integrated construct is further introduced into the host such that an auxotrophy results (e.g., dapA or thyA auxotrophy), which in turn is complemented by a gene product expressed from the biosafety plasmid construct. In some embodiments, the biosafety plasmid further encodes a broad-spectrum toxin (e.g., Kis), while the integrated biosafety construct encodes an anti-toxin (e.g., anti-Kis), permitting propagation of the plasmid in the bacterial cell containing both constructs. Without wishing to be bound by theory, this mechanism functions to select against plasmid spread by making the plasmid DNA itself disadvantageous to maintain by a wild-type bacterium. A non-limiting example of such a bio safety system is shown in FIG. 76A, FIG. 76B, FIG. 76C, and FIG. 76D.

In other embodiments, auxotrophic modifications may also be used to screen for mutant bacteria that produce the anti-cancer molecule.

Genetic Regulatory Circuits

In some embodiments, the genetically engineered bacteria comprise multi-layered genetic regulatory circuits for expressing the constructs described herein (see, e.g., U.S. Provisional Application No. 62/184,811, incorporated herein by reference in its entirety). The genetic regulatory circuits are useful to screen for mutant bacteria that produce an anti-cancer molecule or rescue an auxotroph. In certain embodiments, the invention provides methods for selecting genetically engineered bacteria that produce one or more genes of interest.

In some embodiments, the invention provides genetically engineered bacteria comprising a gene or gene cassette for producing a payload, e.g., a single-chain CTLA-4 antibody, and a T7 polymerase-regulated genetic regulatory circuit. For example, the genetically engineered bacteria comprise a first gene encoding a T7 polymerase, wherein the first gene is operably linked to a fumarate and nitrate reductase regulator (FNR)-responsive promoter; a second gene or gene cassette for producing a payload, wherein the second gene or gene cassette is operably linked to a T7 promoter that is induced by the T7 polymerase; and a third gene encoding an inhibitory factor, lysY, that is capable of inhibiting the T7 polymerase. In the presence of oxygen, FNR does not bind the FNR-responsive promoter, and the payload is not expressed. LysY is expressed constitutively (P-lac constitutive) and further inhibits T7 polymerase. In the absence of oxygen, FNR dimerizes and binds to the FNR-responsive promoter, T7 polymerase is expressed at a level sufficient to overcome lysY inhibition, and the payload is expressed. In some embodiments, the lysY gene is operably linked to an additional FNR binding site. In the absence of oxygen, FNR dimerizes to activate T7 polymerase expression as described above, and also inhibits lysY expression.

In some embodiments, the invention provides genetically engineered bacteria comprising a gene or gene cassette for producing a payload, e.g., a single-chain CTLA-4 antibody, and a protease-regulated genetic regulatory circuit. For example, the genetically engineered bacteria comprise a first gene encoding an mf-lon protease, wherein the first gene is operably linked to a FNR-responsive promoter; a second gene or gene cassette for producing a payload operably linked to a tet regulatory region (tetO); and a third gene encoding an mf-lon degradation signal linked to a tet repressor (tetR), wherein the tetR is capable of binding to the tet regulatory region and repressing expression of the second gene or gene cassette. The mf-lon protease is capable of recognizing the mf-lon degradation signal and degrading the tetR. In the presence of oxygen, FNR does not bind the FNR-responsive promoter, the repressor is not degraded, and the payload is not expressed. In the absence of oxygen, FNR dimerizes and binds the FNR-responsive promoter, thereby inducing expression of mf-lon protease. The mf-lon protease recognizes the mf-lon degradation signal and degrades the tetR, and the payload is expressed.

In some embodiments, the invention provides genetically engineered bacteria comprising a gene or gene cassette for producing a payload, e.g., a single-chain CTLA-4 antibody, and a repressor-regulated genetic regulatory circuit. For example, the genetically engineered bacteria comprise a first gene encoding a first repressor, wherein the first gene is operably linked to a FNR-responsive promoter; a second gene or gene cassette for producing a payload operably linked to a first regulatory region comprising a constitutive promoter; and a third gene encoding a second repressor, wherein the second repressor is capable of binding to the first regulatory region and repressing expression of the second gene or gene cassette. The third gene is operably linked to a second regulatory region comprising a constitutive promoter, wherein the first repressor is capable of binding to the second regulatory region and inhibiting expression of the second repressor. In the presence of oxygen, FNR does not bind the FNR-responsive promoter, the first repressor is not expressed, the second repressor is expressed, and the payload is not expressed. In the absence of oxygen, FNR dimerizes and binds the FNR-responsive promoter, the first repressor is expressed, the second repressor is not expressed, and the payload is expressed.

Examples of repressors useful in these embodiments include, but are not limited to, ArgR, TetR, ArsR, AscG, LacI, CscR, DeoR, DgoR, FruR, GalR, GatR, CI, LexA, RafR, QacR, and PtxS (US20030166191).

In some embodiments, the invention provides genetically engineered bacteria comprising a gene or gene cassette for producing a payload, e.g., a single-chain CTLA-4 antibody, and a regulatory RNA-regulated genetic regulatory circuit. For example, the genetically engineered bacteria comprise a first gene encoding a regulatory RNA, wherein the first gene is operably linked to a FNR-responsive promoter, and a second gene or gene cassette for producing a payload. The second gene or gene cassette is operably linked to a constitutive promoter and further linked to a nucleotide sequence capable of producing an mRNA hairpin that inhibits translation of the payload. The regulatory RNA is capable of eliminating the mRNA hairpin and inducing payload translation via the ribosomal binding site. In the presence of oxygen, FNR does not bind the FNR-responsive promoter, the regulatory RNA is not expressed, and the mRNA hairpin prevents the payload from being translated. In the absence of oxygen, FNR dimerizes and binds the FNR-responsive promoter, the regulatory RNA is expressed, the mRNA hairpin is eliminated, and the payload is expressed.

In some embodiments, the invention provides genetically engineered bacteria comprising a gene or gene cassette for producing a payload, e.g., a single-chain CTLA-4 antibody, and a CRISPR-regulated genetic regulatory circuit. For example, the genetically engineered bacteria comprise a Cas9 protein; a first gene encoding a CRISPR guide RNA, wherein the first gene is operably linked to a FNR-responsive promoter; a second gene or gene cassette for producing a payload, wherein the second gene or gene cassette is operably linked to a regulatory region comprising a constitutive promoter; and a third gene encoding a repressor operably linked to a constitutive promoter, wherein the repressor is capable of binding to the regulatory region and repressing expression of the second gene or gene cassette. The third gene is further linked to a CRISPR target sequence that is capable of binding to the CRISPR guide RNA, wherein said binding to the CRISPR guide RNA induces cleavage by the Cas9 protein and inhibits expression of the repressor. In the presence of oxygen, FNR does not bind the FNR-responsive promoter, the guide RNA is not expressed, the repressor is expressed, and the payload is not expressed. In the absence of oxygen, FNR dimerizes and binds the FNR-responsive promoter, the guide RNA is expressed, the repressor is not expressed, and the payload is expressed.

In some embodiments, the invention provides genetically engineered bacteria comprising a gene or gene cassette for producing a payload, e.g., a single-chain CTLA-4 antibody, and a recombinase-regulated genetic regulatory circuit. For example, the genetically engineered bacteria comprise a first gene encoding a recombinase, wherein the first gene is operably linked to a FNR-responsive promoter, and a second gene or gene cassette for producing a payload operably linked to a constitutive promoter. The second gene or gene cassette is inverted in orientation (3' to 5') and flanked by recombinase binding sites, and the recombinase is capable of binding to the recombinase binding sites to induce expression of the second gene or gene cassette by reverting its orientation (5' to 3'). In the presence of oxygen, FNR does not bind the FNR-responsive promoter, the recombinase is not expressed, the payload remains in the 3' to 5' orientation, and no functional payload is produced. In the absence of oxygen, FNR dimerizes and binds the FNR-responsive promoter, the recombinase is expressed, the payload is reverted to the 5' to 3' orientation, and functional payload is produced.

In some embodiments, the invention provides genetically engineered bacteria comprising a gene or gene cassette for producing a payload, e.g., a single-chain CTLA-4 antibody, and a polymerase- and recombinase-regulated genetic regulatory circuit. For example, the genetically engineered bacteria comprise a first gene encoding a recombinase, wherein the first gene is operably linked to a FNR-responsive promoter; a second gene or gene cassette for producing a payload operably linked to a T7 promoter; a third gene encoding a T7 polymerase, wherein the T7 polymerase is capable of binding to the T7 promoter and inducing expression of the payload. The third gene encoding the T7 polymerase is inverted in orientation (3' to 5') and flanked by recombinase binding sites, and the recombinase is capable of binding to the recombinase binding sites to induce expression of the T7 polymerase gene by reverting its orientation (5' to 3'). In the presence of oxygen, FNR does not bind the FNR-responsive promoter, the recombinase is not expressed, the T7 polymerase gene remains in the 3' to 5' orientation, and the payload is not expressed. In the absence of oxygen, FNR dimerizes and binds the FNR-responsive promoter, the recombinase is expressed, the T7 polymerase gene is reverted to the 5' to 3' orientation, and the payload is expressed.

Host-Plasmid Mutual Dependency

In some embodiments, the genetically engineered bacteria of the invention also comprise a plasmid that has been modified to create a host-plasmid mutual dependency. In certain embodiments, the mutually dependent host-plasmid platform is GeneGuard (Wright et al., 2015). In some embodiments, the GeneGuard plasmid comprises (i) a conditional origin of replication, in which the requisite replication initiator protein is provided in trans; (ii) an auxotrophic modification that is rescued by the host via genomic translocation and is also compatible for use in rich media; and/or (iii) a nucleic acid sequence which encodes a broad-spectrum toxin. The toxin gene may be used to select against plasmid spread by making the plasmid DNA itself disadvantageous for strains not expressing the anti-toxin (e.g., a wild-type bacterium). In some embodiments, the GeneGuard plasmid is stable for at least 100 generations without antibiotic selection. In some embodiments, the GeneGuard plasmid does not disrupt growth of the host. The GeneGuard plasmid is used to greatly reduce unintentional plasmid propagation in the genetically engineered bacteria of the invention.

The mutually dependent host-plasmid platform may be used alone or in combination with other biosafety mechanisms, such as those described herein (e.g., kill switches, auxotrophies). In some embodiments, the genetically engineered bacteria comprise a GeneGuard plasmid. In other embodiments, the genetically engineered bacteria comprise a GeneGuard plasmid and/or one or more kill switches. In other embodiments, the genetically engineered bacteria comprise a GeneGuard plasmid and/or one or more auxotrophies. In still other embodiments, the genetically engineered bacteria comprise a GeneGuard plasmid, one or more kill switches, and/or one or more auxotrophies.

Kill Switch

In some embodiments, the genetically engineered bacteria of the invention also comprise a kill switch (see, e.g., U.S. Provisional Application Nos. 62/183,935 and 62/263,329 incorporated herein by reference in their entireties). The kill switch is intended to actively kill engineered microbes in response to external stimuli. As opposed to an auxotrophic mutation where bacteria die because they lack an essential nutrient for survival, the kill switch is triggered by a particular factor in the environment that induces the production of toxic molecules within the microbe that cause cell death.

Bacteria engineered with kill switches have been engineered for in vitro research purposes, e.g., to limit the spread of a biofuel-producing microorganism outside of a laboratory environment. Bacteria engineered for in vivo administration to treat a disease or disorder may also be programmed to die at a specific time after the expression and delivery of a heterologous gene or genes, for example, a therapeutic gene(s) or after the subject has experienced the therapeutic effect. For example, in some embodiments, the kill switch is activated to kill the bacteria after a period of time following oxygen level-dependent expression of the anti-cancer molecule, e.g., a CTLA-4 inhibitor. In some embodiments, the kill switch is activated in a delayed fashion following oxygen level-dependent expression of the anti-cancer molecule. Alternatively, the bacteria may be engineered to die if the bacteria have spread outside of a tumor site. Specifically, it may be useful to prevent the spread of the microorganism outside the area of interest (for example, outside of the tumor site) within the subject, or spread of the microorganism outside of the subject into the environment (for example, spread to the environment through the blood or stool of the subject). Examples of such toxins that can be used in kill switches include, but are not limited to, bacteriocins, lysins, and other molecules that cause cell death by lysing cell membranes, degrading cellular DNA, or other mechanisms. Such toxins can be used individually or in combination. The switches that control their production can be based on, for example, transcriptional activation (toggle switches; see, e.g., Gardner et al., 2000), translation (riboregulators), or DNA recombination (recombinase-based switches), and can sense environmental stimuli such as anaerobiosis or reactive oxygen species. These switches can be activated by a single environmental factor or may require several activators in AND, OR, NAND and NOR logic configurations to induce cell death. For example, an AND riboregulator switch is activated by tetracycline, isopropyl β-D-1-thiogalactopyranoside (IPTG), and arabinose to induce the expression of lysins, which permeabilize the cell membrane and kill the cell. IPTG induces the expression of the endolysin and holin mRNAs, which are then derepressed by the addition of arabinose and tetracycline. All three inducers must be present to cause cell death. Examples of kill switches are known in the art (Callura et al., 2010). In some embodiments, the kill switch is activated to kill the bacteria after a period of time following oxygen level-dependent expression of the anti-cancer molecule. In some embodiments, the kill switch is activated in a delayed fashion following oxygen level-dependent expression of the anti-cancer molecule.

Kill switches can be designed such that a toxin is produced in response to an environmental condition or external signal (e.g., the bacteria is killed in response to an external cue) or, alternatively designed such that a toxin is produced once an environmental condition no longer exists or an external signal is ceased.

Thus, in some embodiments, the genetically engineered bacteria of the disclosure are further programmed to die after sensing an exogenous environmental signal, for example, in a low oxygen environment. In some embodiments, the genetically engineered bacteria of the present disclosure comprise one or more genes encoding one or more recombinase(s), whose expression is induced in response to an environmental condition or signal and causes one or more recombination events that ultimately leads to the expression of a toxin which kills the cell. In some embodiments, the at least one recombination event is the flipping of an inverted heterologous gene encoding a bacterial toxin which is then constitutively expressed after it is flipped by the first recombinase. In one embodiment, constitutive expression of the bacterial toxin kills the genetically engineered bacterium. In these types of kill switch systems, once the engineered bacterial cell senses the exogenous environmental condition and expresses the heterologous gene of interest, the recombinant bacterial cell is no longer viable.

In another embodiment in which the genetically engineered bacteria of the present disclosure express one or more recombinase(s) in response to an environmental condition or signal causing at least one recombination event, the genetically engineered bacterium further expresses a heterologous gene encoding an anti-toxin in response to an exogenous environmental condition or signal. In one embodiment, the at least one recombination event is flipping of an inverted heterologous gene encoding a bacterial toxin by a first recombinase. In one embodiment, the inverted heterologous gene encoding the bacterial toxin is located between a first forward recombinase recognition sequence and a first reverse recombinase recognition sequence. In one embodiment, the heterologous gene encoding the bacterial toxin is constitutively expressed after it is flipped by the first recombinase. In one embodiment, the anti-toxin inhibits the activity of the toxin, thereby delaying death of the genetically engineered bacterium. In one embodiment, the genetically engineered bacterium is killed by the bacterial toxin when the heterologous gene encoding the anti-toxin is no longer expressed when the exogenous environmental condition is no longer present.

In another embodiment, the at least one recombination event is flipping of an inverted heterologous gene encoding a second recombinase by a first recombinase, followed by the flipping of an inverted heterologous gene encoding a bacterial toxin by the second recombinase. In one embodiment, the inverted heterologous gene encoding the second recombinase is located between a first forward recombinase recognition sequence and a first reverse recombinase recognition sequence. In one embodiment, the inverted heterologous gene encoding the bacterial toxin is located between a second forward recombinase recognition sequence and a second reverse recombinase recognition sequence. In one embodiment, the heterologous gene encoding the second recombinase is constitutively expressed after it is flipped by the first recombinase. In one embodiment, the heterologous gene encoding the bacterial toxin is constitutively expressed after it is flipped by the second recombinase. In one embodiment, the genetically engineered bacterium is killed by the bacterial toxin. In one embodiment, the genetically engineered bacterium further expresses a heterologous gene encoding an anti-toxin in response to the exogenous environmental condition. In one embodiment, the anti-toxin inhibits the activity of the toxin when the exogenous environmental condition is present, thereby delaying death of the genetically engineered bacterium. In one embodiment, the genetically engineered bacterium is killed by the bacterial toxin when the heterologous gene encoding the anti-toxin is no longer expressed when the exogenous environmental condition is no longer present.

In one embodiment, the at least one recombination event is flipping of an inverted heterologous gene encoding a second recombinase by a first recombinase, followed by flipping of an inverted heterologous gene encoding a third recombinase by the second recombinase, followed by flipping of an inverted heterologous gene encoding a bacterial toxin by the third recombinase.

In one embodiment, the at least one recombination event is flipping of an inverted heterologous gene encoding a first excision enzyme by a first recombinase. In one embodiment, the inverted heterologous gene encoding the first excision enzyme is located between a first forward recombinase recognition sequence and a first reverse recombinase recognition sequence. In one embodiment, the heterologous gene encoding the first excision enzyme is constitutively expressed after it is flipped by the first recombinase. In one embodiment, the first excision enzyme excises a first essential gene. In one embodiment, the programmed recombinant bacterial cell is not viable after the first essential gene is excised.

In one embodiment, the first recombinase further flips an inverted heterologous gene encoding a second excision enzyme. In one embodiment, the wherein the inverted heterologous gene encoding the second excision enzyme is located between a second forward recombinase recognition sequence and a second reverse recombinase recognition sequence. In one embodiment, the heterologous gene encoding the second excision enzyme is constitutively expressed after it is flipped by the first recombinase. In one embodiment, the genetically engineered bacterium dies or is no longer viable when the first essential gene and the second essential gene are both excised. In one embodiment, the genetically engineered bacterium dies or is no longer viable when either the first essential gene is excised or the second essential gene is excised by the first recombinase.

In one embodiment, the genetically engineered bacterium dies after the at least one recombination event occurs. In another embodiment, the genetically engineered bacterium is no longer viable after the at least one recombination event occurs.

In any of these embodiment, the recombinase can be a recombinase selected from the group consisting of: BxbI, PhiC31, TP901, BxbI, PhiC31, TP901, HK022, HP1, R4, IntI, Int2, Int3, Int4, Int5, Int6, IntI, Int8, Int9, Int10, Int11, Int12, Int13, Int14, Int15, Int16, Int17, Int18, Int19, Int20, Int21, Int22, Int23, Int24, Int25, Int26, Int27, Int28, Int29, Int30, Int31, Int32, Int33, and Int34, or a biologically active fragment thereof.

In the above-described kill switch circuits, a toxin is produced in the presence of an environmental factor or signal. In another aspect of kill switch circuitry, a toxin may be repressed in the presence of an environmental factor (not produced) and then produced once the environmental condition or external signal is no longer present. Such kill switches are called repression-based kill switches and represent systems in which the bacterial cells are viable only in the presence of an external factor or signal, such as arabinose or other sugar. Exemplary kill switch designs in which the toxin is repressed in the presence of an external factor or signal (and activated once the external signal is removed) are shown in FIGS. 69A-75. The disclosure provides recombinant bacterial cells which express one or more heterologous gene(s) upon sensing arabinose or other sugar in the exogenous environment. In this aspect, the recombinant bacterial cells contain the araC gene, which encodes the AraC transcription factor, as well as one or more genes under the control of the araBAD promoter. In the absence of arabinose, the AraC transcription factor adopts a conformation that represses transcription of genes under the control of the araBAD promoter. In the presence of arabinose, the AraC transcription factor undergoes a conformational change that allows it to bind to and activate the AraBAD promoter, which induces expression of the desired gene, for example tetR, which represses expression of a toxin gene. In this embodiment, the toxing gene is repressed in the presence of arabinose or other sugar. In an environment where arabinose is not present, the tetR gene is not activated and the toxin is expressed, thereby killing the bacteria. The arbinoase system can also be used to express an essential gene, in which the essential gene is only expressed in the presence of arabinose or other sugar and is not expressed when arabinose or other sugar is absent from the environment.

Thus, in some embodiments in which one or more heterologous gene(s) are expressed upon sensing arabinose in the exogenous environment, the one or more heterologous genes are directly or indirectly under the control of the araBAD promoter. In some embodiments, the expressed heterologous gene is selected from one or more of the following: a heterologous therapeutic gene, a heterologous gene encoding an antitoxin, a heterologous gene encoding a repressor protein or polypeptide, for example, a TetR repressor, a heterologous gene encoding an essential protein not found in the bacterial cell, and/or a heterologous encoding a regulatory protein or polypeptide.

Arabinose inducible promoters are known in the art, including $P_{ara}$, $P_{aras}$, $P_{araC}$, and $P_{araBAD}$. In one embodiment, the arabinose inducible promoter is from $E.\ coli$. In some embodiments, the $P_{araC}$ promoter and the $P_{araBAD}$ promoter operate as a bidirectional promoter, with the $P_{araBAD}$ promoter controlling expression of a heterologous gene(s) in one direction, and the $P_{araC}$ (in close proximity to, and on the opposite strand from the $P_{araBAD}$ promoter), controlling expression of a heterologous gene(s) in the other direction. In the presence of arabinose, transcription of both heterologous genes from both promoters is induced. However, in the absence of arabinose, transcription of both heterologous genes from both promoters is not induced.

In one exemplary embodiment of the disclosure, the genetically engineered bacteria of the present disclosure contains a kill-switch having at least the following sequences: a $P_{araBAD}$ promoter operably linked to a heterologous gene encoding a Tetracycline Repressor Protein (TetR), a $P_{araC}$ promoter operably linked to a heterologous gene encoding AraC transcription factor, and a heterologous gene encoding a bacterial toxin operably linked to a promoter which is repressed by the Tetracycline Repressor Protein ($P_{TetR}$). In the presence of arabinose, the AraC transcription factor activates the $P_{araBAD}$ promoter, which activates transcription of the TetR protein, which, in turn, represses transcription of the toxin. In the absence of arabinose, however, AraC suppresses transcription from the $P_{araBAD}$ promoter and no TetR protein is expressed. In this case, expression of the heterologous toxin gene is activated, and the toxin is expressed. The toxin builds up in the recombinant bacterial cell, and the recombinant bacterial cell is killed. In one embodiment, the AraC gene encoding the AraC transcription factor is under the control of a constitutive promoter and is therefore constitutively expressed.

In one embodiment of the disclosure, the genetically engineered bacterium further comprises an antitoxin under the control of a constitutive promoter. In this situation, in the presence of arabinose, the toxin is not expressed due to repression by TetR protein, and the antitoxin protein builds-up in the cell. However, in the absence of arabinose, TetR protein is not expressed, and expression of the toxin is induced. The toxin begins to build-up within the recombinant bacterial cell. The recombinant bacterial cell is no longer viable once the toxin protein is present at either equal or greater amounts than that of the anti-toxin protein in the cell, and the recombinant bacterial cell will be killed by the toxin.

In another embodiment of the disclosure, the genetically engineered bacterium further comprises an antitoxin under the control of the $P_{araBAD}$ promoter. In this situation, in the presence of arabinose, TetR and the anti-toxin are expressed, the anti-toxin builds up in the cell, and the toxin is not expressed due to repression by TetR protein. However, in the absence of arabinose, both the TetR protein and the anti-toxin are not expressed, and expression of the toxin is induced. The toxin begins to build-up within the recombinant bacterial cell. The recombinant bacterial cell is no longer viable once the toxin protein is expressed, and the recombinant bacterial cell will be killed by the toxin.

In another exemplary embodiment of the disclosure, the genetically engineered bacteria of the present disclosure contain a kill-switch having at least the following sequences: a $P_{araBAD}$ promoter operably linked to a heterologous gene encoding an essential polypeptide not found in the recombinant bacterial cell (and required for survival), and a $P_{araC}$ promoter operably linked to a heterologous gene encoding AraC transcription factor. In the presence of arabinose, the AraC transcription factor activates the $P_{araBAD}$ promoter, which activates transcription of the heterologous gene encoding the essential polypeptide, allowing the recombinant bacterial cell to survive. In the absence of arabinose, however, AraC suppresses transcription from the $P_{araBAD}$ promoter and the essential protein required for survival is not expressed. In this case, the recombinant bacterial cell dies in the absence of arabinose. In some embodiments, the sequence of $P_{araBAD}$ promoter operably linked to a heterologous gene encoding an essential polypeptide not found in the recombinant bacterial cell can be present in the bacterial cell in conjunction with the TetR/toxin kill-switch system described directly above. In some embodiments, the sequence of $P_{araBAD}$ promoter operably linked to a heterologous gene encoding an essential polypeptide not found in the recombinant bacterial cell can be present in the bacterial cell in conjunction with the TetR/toxin/anto-toxin kill-switch system described directly above.

In yet other embodiments, the bacteria may comprise a plasmid stability system with a plasmid that produces both a short-lived anti-toxin and a long-lived toxin. In this system, the bacterial cell produces equal amounts of toxin and anti-toxin to neutralize the toxin. However, if/when the cell loses the plasmid, the short-lived anti-toxin begins to decay. When the anti-toxin decays completely the cell dies as a result of the longer-lived toxin killing it.

In some embodiments, the engineered bacteria of the present disclosure that are capable of producing an anti-cancer molecule further comprise the gene(s) encoding the components of any of the above-described kill switch circuits.

In any of the above-described embodiments, the bacterial toxin is selected from the group consisting of a lysin, Hok, Fst, TisB, LdrD, Kid, SymE, MazF, FlmA, Ibs, XCV2162, dinJ, CcdB, MazF, ParE, YafO, Zeta, hicB, relB, yhaV, yoeB, chpBK, hipA, microcin B, microcin B17, microcin C, microcin C7-051, microcin J25, microcin ColV, microcin 24, microcin L, microcin D93, microcin L, microcin E492, microcin H47, microcin 147, microcin M, colicin A, colicin E1, colicin K, colicin N, colicin U, colicin B, colicin Ia, colicin Ib, colicin 5, colicin10, colicin S4, colicin Y, colicin E2, colicin E7, colicin E8, colicin E9, colicin E3, colicin E4, colicin E6; colicin E5, colicin D, colicin M, and cloacin DF13, or a biologically active fragment thereof.

In any of the above-described embodiments, the anti-toxin is selected from the group consisting of an anti-lysin, Sok, RNAII, IstR, RdID, Kis, SymR, MazE, FlmB, Sib, ptaRNA1, yafQ, CcdA, MazE, ParD, yafN, Epsilon, HicA, relE, prlF, yefM, chpBl, hipB, MccE, $MccE^{cTD}$, MccF, Cai, ImmEl, Cki, Cni, Cui, Cbi, Iia, Imm, Cfi, Im10, Csi, Cyi, Im2, Im7, Im8, Im9, Im3, Im4, ImmE6, cloacin immunity protein (Cim), ImmE5, ImmD, and Cmi, or a biologically active fragment thereof.

In one embodiment, the bacterial toxin is bactericidal to the genetically engineered bacterium. In one embodiment, the bacterial toxin is bacteriostatic to the genetically engineered bacterium.

In some embodiments, the engineered bacteria provided herein are capable of producing an anti-cancer molecule, wherein the gene or gene cassette for producing the anti-cancer molecule is controlled by a promoter that is induced under low-oxygen or anaerobic conditions. In some embodiments, the promoter is selected from the fumarate and nitrate reductase regulator (FNR) promoter, arginine deiminiase and nitrate reduction (ANR) promoter, and dissimilatory nitrate respiration regulator (DNR) promoter.

In some embodiments, the genetically engineered bacteria for producing the anti-cancer molecule is an auxotroph selected from a cysE, glnA, ilvD, leuB, lysA, serA, metA, glyA, hisB, ilvA, pheA, proA, thrC, trpC, tyrA, thyA, uraA, dapA, dapB, dapD, dapE, dapF, flhD, metB, metC, proAB, and thi1 auxotroph. In some embodiments, the engineered bacteria have more than one auxotrophy, for example, they may be a AthyA and AdapA auxotroph.

In some embodiments, the genetically engineered bacteria for producing the anti-cancer molecule further comprises a kill switch circuit, such as any of the kill switch circuits provided herein. For example, in some embodiments, the genetically engineered bacteria further comprise one or more genes encoding one or more recombinase(s) under the control of an inducible promoter and an inverted toxin sequence. In some embodiments, the genetically engineered bacteria further comprise one or more genes encoding an anti-toxin. In some embodiments, the engineered bacteria further comprise one or more genes encoding one or more recombinase(s) under the control of an inducible promoter and one or more inverted excision genes, wherein the excision gene(s) encode an enzyme that deletes an essential gene. In some embodiments, the genetically engineered bacteria further comprise one or more genes encoding an anti-toxin.

In some instances, basal or leaky expression from an inducible promoter may result in the activation of the kill switch, thereby creating strong selective pressure for one or more mutations that disable the switch and thus the ability to kill the cell. In some embodiments, an environmental factor, e.g. arabinose, is present during manufacturing, and activates the production of a repressor that shuts down toxin production. Mutations in this circuit, with the exception of the toxin gene itself, will result in death with reduced chance for negative selection. When the environmental factor is absent, the repressor stops being made, and the toxin is produced. When the toxin concentration overcomes that of the antitoxin, the cell dies. In some embodiments, variations in the promoter and ribosome binding sequences of the antitoxin and the toxin allow for tuning of the circuit to produce variations in the timing of cell death. In alternate embodiments, the circuit comprises recombinases that are repressed by tetR and produced in the absence of tetR. These recombinases are capable of flipping the toxin gene or its promoter into the active configuration, thereby resulting in toxin production.

Synthetic gene circuits express on plasmids may function well in the short term but lose ability and/or function in the long term, e.g., in the stringent conditions found in a tumor microenvironment (Danino et al., 2015). In some embodiments, the genetically engineered bacteria comprise stable circuits for expressing genes of interest, e.g., an anti-cancer molecule, over prolonged periods. In some embodiments, the genetically engineered bacteria are capable of targeting cancerous cells and producing an anti-cancer molecule and further comprise a toxin-antitoxin system that simultaneously produces a toxin (hok) and a short-lived antitoxin (sok), wherein loss of the plasmid causes the cell to be killed by the long-lived toxin (Danino et al., 2015; FIG. 74). In some embodiments, the genetically engineered bacteria further comprise alp7 from *B. subtilis* plasmid pL20 and produces filaments that are capable of pushing plasmids to the poles of the cells in order to ensure equal segregation during cell division (Danino et al., 2015).

In some embodiments, the genetically engineered bacteria for producing the anti-cancer molecule is an auxotroph and further comprises a kill switch circuit, such as any of the kill switch circuits described herein.

In some embodiments of the above described genetically engineered bacteria, the gene encoding the anti-cancer molecule is present on a plasmid in the bacterium and operatively linked on the plasmid to the promoter that is induced under low-oxygen or anaerobic conditions. The genetically engineered bacteria are capable of local and tumor-specific delivery of the anti-cancer molecule, e.g., an immune checkpoint inhibitor. In other embodiments, the gene encoding the anti-cancer molecule is present in the bacterial chromosome and is operatively linked in the chromosome to the promoter that is induced under low-oxygen or anaerobic conditions. The genetically engineered bacteria are capable of local and tumor-specific delivery of the anti-cancer molecule, e.g., an immune checkpoint inhibitor.

Pharmaceutical Compositions and Formulations

Pharmaceutical compositions comprising the genetically engineered microorganisms of the invention may be used to treat, manage, ameliorate, and/or prevent cancer. Pharmaceutical compositions of the invention comprising one or more genetically engineered bacteria, and/or one or more genetically engineered OVs, alone or in combination with prophylactic agents, therapeutic agents, and/or pharmaceutically acceptable carriers are provided.

In certain embodiments, the pharmaceutical composition comprises one species, strain, or subtype of bacteria that are engineered to comprise the genetic modifications described herein, e.g., one or more genes encoding one or more anti-cancer molecules. In alternate embodiments, the pharmaceutical composition comprises two or more species, strains, and/or subtypes of bacteria that are each engineered to comprise the genetic modifications described herein, e.g., one or more genes encoding one or more anti-cancer molecules.

In some embodiments, the genetically engineered bacteria are administered systemically or intratumorally as spores. As a non-limiting example, the genetically engineered bacteria are Clostridia, and administration results in a selective colonization of hypoxic/necrotic areas within the tumor. In some embodiments, the spores germinate exclusively in the hypoxic/necrotic regions present in solid tumours and nowhere else in the body.

In certain embodiments, the pharmaceutical composition comprises one type of oncolytiv virus that are engineered to comprise the genetic modifications described herein, e.g., one or more genes encoding one or more anti-cancer molecules. In alternate embodiments, the pharmaceutical composition comprises two or more types of oncolytic virus that are each engineered to comprise the genetic modifications described herein, e.g., one or more genes encoding one or more anti-cancer molecules.

The pharmaceutical compositions of the invention may be formulated in a conventional manner using one or more physiologically acceptable carriers comprising excipients and auxiliaries, which facilitate processing of the active ingredients into compositions for pharmaceutical use. Methods of formulating pharmaceutical compositions are known in the art (see, e.g., "Remington's Pharmaceutical Sciences," Mack Publishing Co., Easton, Pa.). In some embodiments, the pharmaceutical compositions are subjected to tabletting, lyophilizing, direct compression, conventional mixing, dissolving, granulating, levigating, emulsifying, encapsulating, entrapping, or spray drying to form tablets, granulates, nanoparticles, nanocapsules, microcapsules, microtablets, pellets, or powders, which may be enterically coated or uncoated. Appropriate formulation depends on the route of administration.

The genetically engineered microorganisms may be formulated into pharmaceutical compositions in any suitable dosage form (e.g., liquids, capsules, sachet, hard capsules, soft capsules, tablets, enteric coated tablets, suspension powders, granules, or matrix sustained release formations for oral administration) and for any suitable type of administration (e.g., oral, topical, injectable, intravenous, subcutaneous, intratumoral, peritumor, immediate-release, pulsatile-release, delayed-release, or sustained release).

Suitable dosage amounts for the genetically engineered bacteria may range from about $10^4$ to $10^{12}$ bacteria. The composition may be administered once or more daily, weekly, or monthly. The composition may be administered before, during, or following a meal. In one embodiment, the pharmaceutical composition is administered before the subject eats a meal. In one embodiment, the pharmaceutical composition is administered currently with a meal. In on embodiment, the pharmaceutical composition is administered after the subject eats a meal.

The genetically engineered bacteria or genetically engineered virus may be formulated into pharmaceutical compositions comprising one or more pharmaceutically acceptable carriers, thickeners, diluents, buffers, buffering agents, surface active agents, neutral or cationic lipids, lipid complexes, liposomes, penetration enhancers, carrier compounds, and other pharmaceutically acceptable carriers or agents. For example, the pharmaceutical composition may include, but is not limited to, the addition of calcium bicarbonate, sodium bicarbonate, calcium phosphate, various sugars and types of starch, cellulose derivatives, gelatin, vegetable oils, polyethylene glycols, and surfactants, including, for example, polysorbate 20. In some embodiments, the genetically engineered bacteria of the invention may be formulated in a solution of sodium bicarbonate, e.g., 1 molar solution of sodium bicarbonate (to buffer an acidic cellular environment, such as the stomach, for example). The genetically engineered bacteria may be administered and formulated as neutral or salt forms. Pharmaceutically acceptable salts include those formed with anions such as those derived from hydrochloric, phosphoric, acetic, oxalic, tartaric acids, etc., and those formed with cations such as those derived from sodium, potassium, ammonium, calcium, ferric hydroxides, isopropylamine, triethylamine, 2-ethylamino ethanol, histidine, procaine, etc.

The genetically engineered microorganisms may be administered intravenously, e.g., by infusion or injection. Alternatively, the genetically engineered microorganisms may be administered intratumorally and/or peritumorally. In other embodiments, the genetically engineered microorganisms may be administered intra-arterially, intramuscularly, or intraperitoneally. In some embodiments, the genetically engineered bacteria colonize about 20%, 30%, 40%, 50%, 60%, 70%, 80%, 90% or more of the tumor. In some embodiments, the genetically engineered bacteria are co-administered with a PEGylated form of rHuPH20 (PEGPH20) or other agent in order to destroy the tumor septae in order to enhance penetration of the tumor capsule, collagen, and/or stroma. In some embodiments, the genetically engineered bacteria are capable of producing an anti-cancer molecule as well as one or more enzymes that degrade fibrous tissue.

The genetically engineered microorganisms of the disclosure may be administered via intratumoral injection, resulting in bacteria or virus that is directly deposited within the target tumor. Intratumoral injection of the engineered bacteria or virus may elicit a potent localized inflammatory response as well as an adaptive immune response against tumor cells. Bacteria or virus are suspended in solution before being withdrawn into a 1-ml syringe. In some embodiments, the tumor is injected with an 18-gauge multipronged needle (Quadra-Fuse, Rex Medical). The injection site is aseptically prepared. If available, ultrasound or CT may be used to identify a necrotic region of the tumor for injection. If a necrotic region is not identified, the injection can be directed to the center of the tumor. The needle is inserted once into a predefined region, and dispensed with even pressure. The injection needle is removed slowly, and the injection site is sterilized.

Direct intratumoral injection of the genetically engineered bacteria or virus of the invention into solid tumors may be advantageous as compared to intravenous administration. Using an intravenous injection method, only a small proportion of the bacteria may reach the target tumor. For example, following E. coli Nissle injection into the tail vein of 4T1 tumor—bearing mice, most bacteria (>99%) are quickly cleared from the animals and only a small percentage of the administered bacteria colonize the tumor (Stritzker et al., 2007). In particular, in large animals and human patients, which have relatively large blood volumes and relatively small tumors compared to mice, intratumoral injection may be especially beneficial. Injection directly into the tumor allows the delivery of a higher concentration of therapeutic agent and avoids the toxicity, which can result from systemic administration. In addition, intratumoral injection of bacteria induces robust and localized immune responses within the tumor.

Depending on the location, tumor type, and tumor size, different administration techniques may be used, including but not limited to, cutaneous, subcutaneous, and percutaneous injection, therapeutic endoscopic ultrasonography, or endobronchial intratumor delivery. Prior to the intratumor administration procedures, sedation in combination with a local anesthetic and standard cardiac, pressure, and oxygen monitoring, or full anesthesia of the patient is performed.

For some tumors, percutaneous injection can be employed, which is the least invasive administration method. Ultrasound, computed tomography (CT) or fluoroscopy can be used as guidance to introduce and position the needle. Percutaneous intratumoral injection is for example described for hepatocellular carcinoma in Lencioni et al., 2010. Intratumoral injection of cutaneous, subcutaneous, and nodal tumors is for example described in WO/2014/036412 (Amgen) for late stage melanoma.

Single insertion points or multiple insertion points can be used in percutaneous injection protocols. Using a single insertion point, the solution may be injected percutaneously along multiple tracks, as far as the radial reach of the needle allows. In other embodiments, multiple injection points may be used if the tumor is larger than the radial reach of the needle. The needle can be pulled back without exiting, and redirected as often as necessary until the full dose is injected and dispersed. To maintain sterility, a separate needle is used for each injection. Needle size and length varies depending on the tumor type and size.

In some embodiments, the tumor is injected percutaneously with an 18-gauge multipronged needle (Quadra-Fuse, Rex Medical). The device consists of an 18 gauge puncture needle 20 cm in length. The needle has three retractable prongs, each with four terminal side holes and a connector with extension tubing clamp. The prongs are deployed from the lateral wall of the needle. The needle can be introduced percutaneously into the center of the tumor and can be positioned at the deepest margin of the tumor. The prongs are deployed to the margins of the tumor. The prongs are deployed at maximum length and then are retracted at defined intervals. Optionally, one or more rotation-injection-rotation maneuvers can be performed, in which the prongs are retracted, the needle is rotated by a 60 degrees, which is followed by repeat deployment of the prongs and additional injection.

Therapeutic endoscopic ultrasonography (EUS) is employed to overcome the anatomical constraints inherent in gaining access to certain other tumors (Shirley et al., 2013). EUS-guided fine needle injection (EUS-FNI) has been successfully used for antitumor therapies for the treatment of head and neck, esophageal, pancreatic, hepatic, and adrenal masses (Verna et al, 2008). EUS-FNI has been extensively used for pancreatic cancer injections. Fine-needle injection requires the use of the curvilinear echoendoscope. The esophagus is carefully intubated and the echoendoscope is passed into the stomach and duodenum where the pancreatic examination occurs and the target tumor is identified. The largest plane is measured to estimate the tumor volume and to calculate the injection volume. The appropriate volume is drawn into a syringe. A primed 22-gauge fine needle aspiration (FNA) needle is passed into the working channel of the echoendoscope. Under ultrasound guidance, the needle is passed into the tumor. Depending on the size of the tumor, administration can be performed by dividing the tumor into sections and then injecting the corresponding fractions of the volume into each section. Use of an installed endoscopic ultrasound processor with Doppler technology assures there are no arterial or venous structures that may interfere with the needle passage into the tumor (Shirley et al., 2013). In some embodiments, 'multiple injectable needle' (MIN) for EUS-FNI can be used to improvement the injection distribution to the tumor in comparison with straight-type needles (Ohara et al., 2013).

Intratumoral administration for lung cancer, such as non-small cell lung cancer, can be achieved through endobronchial intratumor delivery methods, as described in Celikoglu et al., 2008. Bronchoscopy (trans-nasal or oral) is conducted to visualize the lesion to be treated. The tumor volume can be estimated visually from visible length-width height measurements over the bronchial surface. The needle device is then introduced through the working channel of the bronchoscope. The needle catheter, which consists of a metallic needle attached to a plastic catheter, is placed within a sheath to prevent damage by the needle to the working channel during advancement. The needle size and length varies and is determined according to tumor type and size of the tumor. Needles made from plastic are less rigid than metal needles and are ideal, since they can be passed around sharper bends in the working channel. The needle is inserted into the lesion and the genetically engineered bacteria of the invention are in injected. Needles are inserted repeatedly at several insertion points until the tumor mass is completely perfused. After each injection, the needle is withdrawn entirely from the tumor and is then embedded at another location. At the end of the bronchoscopic injection session, removal of any necrotic debris caused by the treatment may be removed using mechanical dissection, or other ablation techniques accompanied by irrigation and aspiration.

In some embodiments, the genetically engineered bacteria or virus capable of delivering an immune modulator to a target tumor are administrated directly into the tumor using methods, including but not limited to, percutaneous injection, EUS-FNI, or endobronchial intratumor delivery methods. In some cases other techniques, such as laproscopic or open surgical techniques are used to access the target tumor, however, these techniques are much more invasive and bring with them much greater morbidity and longer hospital stays.

In some embodiments, bacteria, e.g., *E. coli* Nissle, or spores, e.g., *Clostridium novyi* NT, are dissolved in sterile phosphate buffered saline (PBS) for systemic or intratumor injection.

The dose to be injected is derived from the type and size of the tumor. The dose of a drug or the genetically engineered bacteria or virus of the invention is typically lower, e.g., orders of magniture lower, than a dose for systemic intravenous administration.

The volume injected into each lesion is based on the size of the tumor. To obtain the tumor volume, a measurement of the largest plane can be conducted. The estimated tumor volume can then inform the determination of the injection volume as a percentage of the total volume. For example, an injection volume of approximately 20-40% of the total tumor volume can be used.

For example, as is for example described in WO/2014/036412 (Amgen), for tumors larger than 5 cm in their largest dimension, up to 4 ml can be injected. For tumors between 2.5 and 5 cm in their largest dimension, up to 2 ml can be injected. For tumors between 2.5 and 5 cm in their largest dimension, up to 2 ml can be injected. For tumors between 1.5 and 2.5 cm in their largest dimension, up to 1 ml can be injected. For tumors between 0.5 and 1.5 cm in their largest dimension, up to 0.5 ml can be injected. For tumors equal or small than 0.5 in their largest dimension, up to 0.1 ml can be injected. Alternatively, ultrasound scan can be used to determine the injection volume that can be taken up by the tumor without leakage into surrounding tissue.

In some embodiments, the treatment regimen will include one or more intratumoral administrations. In some embodiments, a treatment regimen will include an initial dose, which followed by at least one subsequent dose. One or more doses can be administered sequentially in two or more cycles.

For example a first dose may be administered at day 1, and a second dose may be administered after 1, 2, 3, 4, 5, 6, days or 1, 2, 3, or 4 weeks or after a longer interval. Additional doses may be administered after 1, 2, 3, 4, 5, 6, days or after 1, 2, 3, or 4 weeks or longer intervals. In some embodiments, the first and subsequent administrations have the same dosage. In other embodiments, different doses are administered. In some embodiments, more than one dose is administered per day, for example, two, three or more doses can be administered per day.

The routes of administration and dosages described are intended only as a guide. The optimum route of administration and dosage can be readily determined by a skilled practitioner. The dosage may be determined according to various parameters, especially according to the location of the tumor, the size of the tumor, the age, weight and condition of the patient to be treated and the route and method of administration.

In one embodiment, *Clostridium* spores are delivered systemically. In another embodiment, *Clostridium* spores are delivered via intratumor injection. In one embodiment, *E. coli* Nissle are delivered via intratumor injection In other embodiments, *E coli* Nissle, which is known to hone to tumors, is administered via intravenous injection or orally, as described in a mouse model in for example in Danino et al. 2015, or Stritzker et al., 2007, the contents of which is herein incorporated by reference in its entirety. *E. coli* Nissle mutations to reduce toxicity include but are not limited to msbB mutants resulting in non-myristoylated LPS and reduced endotoxin activity, as described in Stritzker et al., 2010 (Stritzker et al, Bioengineered Bugs 1:2, 139-145; Myroystoation negative msbB-mutants of probiotic *E. coli* Nissle 1917 retain tumor specific colonization properties but show less side effects in immunocompetent mice.

For intravenous injection a preferred dose of bacteria is the dose in which the greatest number of bacteria is found in the tumor and the lowest amount found in other tissues. In mice, Stritzker et al (International Journal of Medical Microbiology 297 (2007) 151-162; Tumor specific colonization, tissue distribution, and gene induction by *Escherichia coli* Nissle 1917 in live mice) found that the lowest number of bacteria needed for successful tumor colonization was $2 \times 10^4$ CFU, in which half of the mice showed tumor colonization. Injection of $2 \times 10^5$ and $2 \times 10^6$ CFU resulted in colonization of all tumors, and numbers of bacteria in the tumors increased. However, at higher concentrations, bacterial counts became detectable in the liver and the spleen.

In some embodiments, the genetically engineered microorganisms of the invention may be administered orally. In some embodiments the genetically engineered bacteria may be useful in the prevention, treatment or management of liver cancer or liver metastases. For example, Danino et al showed that orally administered *E. coli* Nissle is able to colonize liver metastases by crossing the gastrointestinal tract in a mouse model of liver metastases (Danino et al., Programmable probiotics for detection of cancer in urine. Science Translational Medicine, 7 (289): 1-10, the contents of which is herein incorporated by reference in its entirety).

In one embodiment the genetically engineered OV is delivered by intratumor injection. In one embodiment, the genetically engineered OV is delivered intrapleurally. In one embodiment, the genetically engineered OV is delivered subcutaneously. In one embodiment, the genetically engineered OV is delivered intravenously. In one embodiment, the genetically engineered OV is delivered intrapleurally.

Tumor types into which the engineered bacteria or virus of the current invention are intratumorally delivered include locally advanced and metastatic tumors, including but not limited to, B, T, and NK cell lymphomas, colon and rectal cancers, melanoma, including metastatic melanoma, mycosis fungoides, Merkel carcinoma, liver cancer, including hepatocellular carcinoma and liver metastasis secondary to colorectal cancer, pancreatic cancer, breast cancer, follicular lymphoma, prostate cancer, refractory liver cancer, and Merkel cell carcinoma.

The genetically engineered microorganisms disclosed herein may be administered topically and formulated in the form of an ointment, cream, transdermal patch, lotion, gel, shampoo, spray, aerosol, solution, emulsion, or other form well known to one of skill in the art. See, e.g., "Remington's Pharmaceutical Sciences," Mack Publishing Co., Easton, Pa. In an embodiment, for non-sprayable topical dosage forms, viscous to semi-solid or solid forms comprising a carrier or one or more excipients compatible with topical application and having a dynamic viscosity greater than water are employed. Suitable formulations include, but are not limited to, solutions, suspensions, emulsions, creams, ointments, powders, liniments, salves, etc., which may be sterilized or mixed with auxiliary agents (e.g., preservatives, stabilizers, wetting agents, buffers, or salts) for influencing various properties, e.g., osmotic pressure. Other suitable topical dosage forms include sprayable aerosol preparations wherein the active ingredient in combination with a solid or liquid inert carrier, is packaged in a mixture with a pressurized volatile (e.g., a gaseous propellant, such as freon) or in a squeeze bottle. Moisturizers or humectants can also be added to pharmaceutical compositions and dosage forms. Examples of such additional ingredients are well known in the art. In one embodiment, the pharmaceutical composition comprising the recombinant bacteria of the invention may be formulated as a hygiene product. For example, the hygiene product may be an antibacterial formulation, or a fermentation product such as a fermentation broth. Hygiene products may be, for example, shampoos, conditioners, creams, pastes, lotions, and lip balms.

The genetically engineered microorganisms disclosed herein may be administered orally and formulated as tablets, pills, dragees, capsules, liquids, gels, syrups, slurries, suspensions, etc. Pharmacological compositions for oral use can be made using a solid excipient, optionally grinding the resulting mixture, and processing the mixture of granules, after adding suitable auxiliaries if desired, to obtain tablets or dragee cores. Suitable excipients include, but are not limited to, fillers such as sugars, including lactose, sucrose, mannitol, or sorbitol; cellulose compositions such as maize starch, wheat starch, rice starch, potato starch, gelatin, gum tragacanth, methyl cellulose, hydroxypropylmethyl-cellulose, sodium carbomethylcellulose; and/or physiologically acceptable polymers such as polyvinylpyrrolidone (PVP) or polyethylene glycol (PEG). Disintegrating agents may also be added, such as cross-linked polyvinylpyrrolidone, agar, alginic acid or a salt thereof such as sodium alginate.

Tablets or capsules can be prepared by conventional means with pharmaceutically acceptable excipients such as binding agents (e.g., pregelatinised maize starch, polyvinylpyrrolidone, hydroxypropyl methylcellulose, carboxymethylcellulose, polyethylene glycol, sucrose, glucose, sorbitol, starch, gum, kaolin, and tragacanth); fillers (e.g., lactose, microcrystalline cellulose, or calcium hydrogen phosphate); lubricants (e.g., calcium, aluminum, zinc, stearic acid, polyethylene glycol, sodium lauryl sulfate, starch, sodium benzoate, L-leucine, magnesium stearate, talc, or silica); disintegrants (e.g., starch, potato starch, sodium starch glycolate, sugars, cellulose derivatives, silica powders); or wetting agents (e.g., sodium lauryl sulphate). The tablets may be coated by methods well known in the art. A coating shell may be present, and common membranes include, but are not limited to, polylactide, polyglycolic acid, polyanhydride, other biodegradable polymers, alginate-polylysine-alginate (APA), alginate-polymethylene-co-guanidine-alginate (A-PMCG-A), hydroymethylacrylate-methyl methacrylate (HEMA-MMA), multilayered HEMA-MMA-MAA, polyacrylonitrilevinylchloride (PAN-PVC), acrylonitrile/sodium metallylsulfonate (AN-69), polyethylene glycol/poly pentamethylcyclopentasiloxane/polydimethylsiloxane (PEG/PD5/PDMS), poly N,N-dimethyl acrylamide (PDMAAm), siliceous encapsulates, cellulose sulphate/sodium alginate/polymethylene-co-guanidine (CS/A/PMCG), cellulose acetate phthalate, calcium alginate, k-carrageenan-locust bean gum gel beads, gellan-xanthan beads, poly(lactide-co-glycolides), carrageenan, starch poly-anhydrides, starch polymethacrylates, polyamino acids, and enteric coating polymers.

In some embodiments, the genetically engineered bacteria are enterically coated for release into the gut or a particular region of the gut, for example, the large intestine. The typical pH profile from the stomach to the colon is about 1-4 (stomach), 5.5-6 (duodenum), 7.3-8.0 (ileum), and 5.5-6.5 (colon). In some diseases, the pH profile may be modified. In some embodiments, the coating is degraded in specific pH environments in order to specify the site of release. In some embodiments, at least two coatings are used. In some embodiments, the outside coating and the inside coating are degraded at different pH levels.

In some embodiments, enteric coating materials may be used, in one or more coating layers (e.g., outer, inner and/or intermediate coating layers). Enteric coated polymers remain unionised at low pH, and therefore remain insoluble. But as the pH increases in the gastrointestinal tract, the acidic functional groups are capable of ionisation, and the polymer swells or becomes soluble in the intestinal fluid.

Materials used for enteric coatings include Cellulose acetate phthalate (CAP), Poly(methacrylic acid-co-methyl methacrylate), Cellulose acetate trimellitate (CAT), Poly (vinyl acetate phthalate) (PVAP) and Hydroxypropyl methylcellulose phthalate (HPMCP), fatty acids, waxes, Shellac (esters of aleuritic acid), plastics and plant fibers. Additionally, Zein, Aqua-Zein (an aqueous zein formulation containing no alcohol), amylose starch and starch derivatives, and dextrins (e.g., maltodextrin) are also used. Other known enteric coatings include ethylcellulose, methylcellulose, hydroxypropyl methylcellulose, amylose acetate phthalate, cellulose acetate phthalate, hydroxyl propyl methyl cellulose phthalate, an ethylacrylate, and a methylmethacrylate.

Coating polymers also may comprise one or more of, phthalate derivatives, CAT, HPMCAS, polyacrylic acid derivatives, copolymers comprising acrylic acid and at least one acrylic acid ester, Eudragit™ S (poly(methacrylic acid, methyl methacrylate)1:2); Eudragit L100™ S (poly(methacrylic acid, methyl methacrylate)1:1); Eudragit L30D™ (poly(methacrylic acid, ethyl acrylate)1:1); and (Eudragit L100-55) (poly(methacrylic acid, ethyl acrylate)1:1) (Eudragit™ L is an anionic polymer synthesized from methacrylic acid and methacrylic acid methyl ester), polymethyl methacrylate blended with acrylic acid and acrylic ester copolymers, alginic acid, ammonia alginate, sodium, potassium, magnesium or calcium alginate, vinyl acetate copolymers, polyvinyl acetate 30D (30% dispersion in water), a neutral methacrylic ester comprising poly(dimethylaminoethylacrylate) ("Eudragit E™"), a copolymer of methylmethacrylate and ethylacrylate with trimethylammonioethyl methacrylate chloride, a copolymer of methylmethacrylate and ethylacrylate, Zein, shellac, gums, or polysaccharides, or a combination thereof.

Coating layers may also include polymers which contain Hydroxypropylmethylcellulose (HPMC), Hydroxypropylethylcellulose (HPEC), Hydroxypropylcellulose (HPC), hydroxypropylethylcellulose (HPEC), hydroxymethylpropylcellulose (HMPC), ethylhydroxyethylcellulose (EHEC) (Ethulose), hydroxyethylmethylcellulose (HEMC), hydroxymethylethylcellulose (HMEC), propylhydroxyethylcellulose (PHEC), methylhydroxyethylcellulose (M H EC), hydrophobically modified hydroxyethylcellulose (NEXTON), carboxymethyl hydroxyethylcellulose (CMHEC), Methylcellulose, Ethylcellulose, water soluble vinyl acetate copolymers, gums, polysaccharides such as alginic acid and alginates such as ammonia alginate, sodium alginate, potassium alginate, acid phthalate of carbohydrates, amylose acetate phthalate, cellulose acetate phthalate (CAP), cellulose ester phthalates, cellulose ether phthalates, hydroxypropylcellulose phthalate (HPCP), hydroxypropylethylcellulose phthalate (HPECP), hydroxyproplymethylcellulose phthalate (HPMCP), hydroxyproplymethylcellulose acetate succinate (HPMCAS).

In some embodiments, the genetically engineered microorganisms are enterically coated for release into the gut or a particular region of the gut, for example, the large intestine. The typical pH profile from the stomach to the colon is about 1-4 (stomach), 5.5-6 (duodenum), 7.3-8.0 (ileum), and 5.5-6.5 (colon). In some diseases, the pH profile may be modified. In some embodiments, the coating is degraded in specific pH environments in order to specify the site of release. In some embodiments, at least two coatings are used. In some embodiments, the outside coating and the inside coating are degraded at different pH levels.

Liquid preparations for oral administration may take the form of solutions, syrups, suspensions, or a dry product for constitution with water or other suitable vehicle before use. Such liquid preparations may be prepared by conventional means with pharmaceutically acceptable agents such as suspending agents (e.g., sorbitol syrup, cellulose derivatives, or hydrogenated edible fats); emulsifying agents (e.g., lecithin or acacia); non-aqueous vehicles (e.g., almond oil, oily esters, ethyl alcohol, or fractionated vegetable oils); and preservatives (e.g., methyl or propyl-p-hydroxybenzoates or sorbic acid). The preparations may also contain buffer salts, flavoring, coloring, and sweetening agents as appropriate. Preparations for oral administration may be suitably formulated for slow release, controlled release, or sustained release of the genetically engineered microorganisms described herein.

In one embodiment, the genetically engineered microorganisms of the disclosure may be formulated in a composition suitable for administration to pediatric subjects. As is well known in the art, children differ from adults in many aspects, including different rates of gastric emptying, pH, gastrointestinal permeability, etc. (Ivanovska et al., Pediatrics, 134(2):361-372, 2014). Moreover, pediatric formulation acceptability and preferences, such as route of administration and taste attributes, are critical for achieving acceptable pediatric compliance. Thus, in one embodiment, the composition suitable for administration to pediatric subjects may include easy-to-swallow or dissolvable dosage forms, or more palatable compositions, such as compositions with added flavors, sweeteners, or taste blockers. In one embodiment, a composition suitable for administration to pediatric subjects may also be suitable for administration to adults.

In one embodiment, the composition suitable for administration to pediatric subjects may include a solution, syrup, suspension, elixir, powder for reconstitution as suspension or solution, dispersible/effervescent tablet, chewable tablet, gummy candy, lollipop, freezer pop, troche, chewing gum, oral thin strip, orally disintegrating tablet, sachet, soft gelatin capsule, sprinkle oral powder, or granules. In one embodiment, the composition is a gummy candy, which is made from a gelatin base, giving the candy elasticity, desired chewy consistency, and longer shelf-life. In some embodiments, the gummy candy may also comprise sweeteners or flavors.

In one embodiment, the composition suitable for administration to pediatric subjects may include a flavor. As used herein, "flavor" is a substance (liquid or solid) that provides a distinct taste and aroma to the formulation. Flavors also help to improve the palatability of the formulation. Flavors include, but are not limited to, strawberry, vanilla, lemon, grape, bubble gum, and cherry.

In certain embodiments, the genetically engineered microorganisms may be orally administered, for example, with an inert diluent or an assimilable edible carrier. The compound may also be enclosed in a hard or soft shell gelatin capsule, compressed into tablets, or incorporated directly into the subject's diet. For oral therapeutic administration, the compounds may be incorporated with excipients and used in the form of ingestible tablets, buccal tablets, troches, capsules, elixirs, suspensions, syrups, wafers, and the like. To administer a compound by other than parenteral administration, it may be necessary to coat the compound with, or co-administer the compound with, a material to prevent its inactivation.

In another embodiment, the pharmaceutical composition comprising the recombinant bacteria of the invention may be a comestible product, for example, a food product. In one embodiment, the food product is milk, concentrated milk, fermented milk (yogurt, sour milk, frozen yogurt, lactic acid bacteria-fermented beverages), milk powder, ice cream, cream cheeses, dry cheeses, soybean milk, fermented soybean milk, vegetable-fruit juices, fruit juices, sports drinks, confectionery, candies, infant foods (such as infant cakes), nutritional food products, animal feeds, or dietary supplements. In one embodiment, the food product is a fermented food, such as a fermented dairy product. In one embodiment, the fermented dairy product is yogurt. In another embodiment, the fermented dairy product is cheese, milk, cream, ice cream, milk shake, or kefir. In another embodiment, the recombinant bacteria of the invention are combined in a preparation containing other live bacterial cells intended to serve as probiotics. In another embodiment, the food product is a beverage. In one embodiment, the beverage is a fruit juice-based beverage or a beverage containing plant or herbal extracts. In another embodiment, the food product is a jelly or a pudding. Other food products suitable for administration of the recombinant bacteria of the invention are well known in the art. For example, see U.S. 2015/0359894 and US 2015/0238545, the entire contents of each of which are expressly incorporated herein by reference. In yet another embodiment, the pharmaceutical composition of the invention is injected into, sprayed onto, or sprinkled onto a food product, such as bread, yogurt, or cheese.

In some embodiments, the composition is formulated for intraintestinal administration, intrajejunal administration, intraduodenal administration, intraileal administration, gastric shunt administration, or intracolic administration, via nanoparticles, nanocapsules, microcapsules, or microtablets, which are enterically coated or uncoated. The pharmaceutical compositions may also be formulated in rectal compositions such as suppositories or retention enemas, using, e.g., conventional suppository bases such as cocoa butter or other glycerides. The compositions may be suspensions, solutions, or emulsions in oily or aqueous vehicles, and may contain suspending, stabilizing and/or dispersing agents.

The genetically engineered microorganisms described herein may be administered intranasally, formulated in an aerosol form, spray, mist, or in the form of drops, and conveniently delivered in the form of an aerosol spray presentation from pressurized packs or a nebuliser, with the use of a suitable propellant (e.g., dichlorodifluoromethane, trichlorofluoromethane, dichlorotetrafluoroethane, carbon dioxide or other suitable gas). Pressurized aerosol dosage units may be determined by providing a valve to deliver a metered amount. Capsules and cartridges (e.g., of gelatin) for use in an inhaler or insufflator may be formulated containing a powder mix of the compound and a suitable powder base such as lactose or starch.

The genetically engineered microorganisms may be administered and formulated as depot preparations. Such long acting formulations may be administered by implantation or by injection, including intravenous injection, subcutaneous injection, local injection, direct injection, or infusion. For example, the compositions may be formulated with suitable polymeric or hydrophobic materials (e.g., as an emulsion in an acceptable oil) or ion exchange resins, or as sparingly soluble derivatives (e.g., as a sparingly soluble salt).

In some embodiments, disclosed herein are pharmaceutically acceptable compositions in single dosage forms. Single dosage forms may be in a liquid or a solid form. Single dosage forms may be administered directly to a patient without modification or may be diluted or reconstituted prior to administration. In certain embodiments, a single dosage form may be administered in bolus form, e.g., single injection, single oral dose, including an oral dose that comprises multiple tablets, capsule, pills, etc. In alternate embodiments, a single dosage form may be administered over a period of time, e.g., by infusion.

Single dosage forms of the pharmaceutical composition may be prepared by portioning the pharmaceutical composition into smaller aliquots, single dose containers, single dose liquid forms, or single dose solid forms, such as tablets, granulates, nanoparticles, nanocapsules, microcapsules, microtablets, pellets, or powders, which may be enterically coated or uncoated. A single dose in a solid form may be reconstituted by adding liquid, typically sterile water or saline solution, prior to administration to a patient.

In other embodiments, the composition can be delivered in a controlled release or sustained release system. In one embodiment, a pump may be used to achieve controlled or sustained release. In another embodiment, polymeric materials can be used to achieve controlled or sustained release of the therapies of the present disclosure (see e.g., U.S. Pat. No. 5,989,463). Examples of polymers used in sustained release formulations include, but are not limited to, poly(2-hydroxy ethyl methacrylate), poly(methyl methacrylate), poly(acrylic acid), poly(ethylene-co-vinyl acetate), poly (methacrylic acid), polyglycolides (PLG), polyanhydrides, poly(N-vinyl pyrrolidone), poly(vinyl alcohol), polyacrylamide, poly(ethylene glycol), polylactides (PLA), poly(lactide-co-glycolides) (PLGA), and polyorthoesters. The polymer used in a sustained release formulation may be inert, free of leachable impurities, stable on storage, sterile, and biodegradable. In some embodiments, a controlled or sustained release system can be placed in proximity of the prophylactic or therapeutic target, thus requiring only a fraction of the systemic dose. Any suitable technique known to one of skill in the art may be used.

Dosage regimens may be adjusted to provide a therapeutic response. Dosing can depend on several factors, including severity and responsiveness of the disease, route of administration, time course of treatment (days to months to years), and time to amelioration of the disease. For example, a single bolus may be administered at one time, several divided doses may be administered over a predetermined period of time, or the dose may be reduced or increased as indicated by the therapeutic situation. The specification for the dosage is dictated by the unique characteristics of the active compound and the particular therapeutic effect to be achieved. Dosage values may vary with the type and severity of the condition to be alleviated. For any particular subject, specific dosage regimens may be adjusted over time according to the individual need and the professional judgment of the treating clinician. Toxicity and therapeutic efficacy of compounds provided herein can be determined by standard pharmaceutical procedures in cell culture or animal models. For example, $LD_{50}$, $ED_{50}$, $EC_{50}$, and $IC_{50}$ may be determined, and the dose ratio between toxic and therapeutic effects ($LD_{50}/ED_{50}$) may be calculated as the therapeutic index. Compositions that exhibit toxic side effects may be used, with careful modifications to minimize potential damage to reduce side effects. Dosing may be estimated initially from cell culture assays and animal models. The data obtained from in vitro and in vivo assays and animal studies can be used in formulating a range of dosage for use in humans.

The ingredients are supplied either separately or mixed together in unit dosage form, for example, as a dry lyophilized powder or water-free concentrate in a hermetically sealed container such as an ampoule or sachet indicating the quantity of active agent. If the mode of administration is by injection, an ampoule of sterile water for injection or saline can be provided so that the ingredients may be mixed prior to administration.

The pharmaceutical compositions may be packaged in a hermetically sealed container such as an ampoule or sachet indicating the quantity of the agent. In one embodiment, one or more of the pharmaceutical compositions is supplied as a dry sterilized lyophilized powder or water-free concentrate in a hermetically sealed container and can be reconstituted (e.g., with water or saline) to the appropriate concentration for administration to a subject. In an embodiment, one or more of the prophylactic or therapeutic agents or pharmaceutical compositions is supplied as a dry sterile lyophilized powder in a hermetically sealed container stored between 2° C. and 8° C. and administered within 1 hour, within 3 hours, within 5 hours, within 6 hours, within 12 hours, within 24 hours, within 48 hours, within 72 hours, or within one week after being reconstituted. Cryoprotectants can be included for a lyophilized dosage form, principally 0-10% sucrose (optimally 0.5-1.0%). Other suitable cryoprotectants include trehalose and lactose. Other suitable bulking agents include glycine and arginine, either of which can be included at a concentration of 0-0.05%, and polysorbate-80 (optimally included at a concentration of 0.005-0.01%). Additional surfactants include but are not limited to polysorbate 20 and BRIJ surfactants. The pharmaceutical composition may be prepared as an injectable solution and can further comprise an agent useful as an adjuvant, such as those used to increase absorption or dispersion, e.g., hyaluronidase.

In some embodiments, the genetically engineered microorganisms and composition thereof is formulated for intravenous administration, intratumor administration, or peritumor administration. The genetically engineered microorganisms may be formulated as depot preparations. Such long acting formulations may be administered by implantation or by injection. For example, the compositions may be formulated with suitable polymeric or hydrophobic materials (e.g., as an emulsion in an acceptable oil) or ion exchange resins, or as sparingly soluble derivatives (e.g., as a sparingly soluble salt).

In some embodiments, the genetically engineered OVs are prepared for delivery, taking into consideration the need for efficient delivery and for overcoming the host antiviral immune response. Approaches to evade antiviral response include the administration of different viral serotypes as par of the treatment regimen (serotype switching), formulation, such as polymer coating to mask the virus from antibody recognition and the use of cells as delivery vehicles.

In another embodiment, the composition can be delivered in a controlled release or sustained release system. In one embodiment, a pump may be used to achieve controlled or sustained release. In another embodiment, polymeric materials can be used to achieve controlled or sustained release of the therapies of the present disclosure (see e.g., U.S. Pat. No. 5,989,463). Examples of polymers used in sustained release formulations include, but are not limited to, poly(2-hydroxy ethyl methacrylate), poly(methyl methacrylate), poly(acrylic acid), poly(ethylene-co-vinyl acetate), poly (methacrylic acid), polyglycolides (PLG), polyanhydrides, poly(N-vinyl pyrrolidone), poly(vinyl alcohol), polyacrylamide, poly(ethylene glycol), polylactides (PLA), poly(lactide-co-glycolides) (PLGA), and polyorthoesters. The polymer used in a sustained release formulation may be inert, free of leachable impurities, stable on storage, sterile, and biodegradable. In some embodiments, a controlled or sustained release system can be placed in proximity of the prophylactic or therapeutic target, thus requiring only a fraction of the systemic dose. Any suitable technique known to one of skill in the art may be used.

The genetically engineered bacteria of the invention may be administered and formulated as neutral or salt forms. Pharmaceutically acceptable salts include those formed with anions such as those derived from hydrochloric, phosphoric, acetic, oxalic, tartaric acids, etc., and those formed with cations such as those derived from sodium, potassium, ammonium, calcium, ferric hydroxides, isopropylamine, triethylamine, 2-ethylamino ethanol, histidine, procaine, etc.

Methods of Treatment

Another aspect of the invention provides methods of treating cancer. In some embodiments, the invention provides methods for reducing, ameliorating, or eliminating one or more symptom(s) associated with cancer. In some embodiments, the cancer is selected from adrenal cancer, adrenocortical carcinoma, anal cancer, appendix cancer, bile duct cancer, bladder cancer, bone cancer (e.g., Ewing sarcoma tumors, osteosarcoma, malignant fibrous histiocytoma), brain cancer (e.g., astrocytomas, brain stem glioma, craniopharyngioma, ependymoma), bronchial tumors, central nervous system tumors, breast cancer, Castleman disease, cervical cancer, colon cancer, rectal cancer, colorectal cancer, endometrial cancer, esophageal cancer, eye cancer, gallbladder cancer, gastrointestinal cancer, gastrointestinal carcinoid tumors, gastrointestinal stromal tumors, gestational trophoblastic disease, heart cancer, Kaposi sarcoma, kidney cancer, largyngeal cancer, hypopharyngeal cancer, leukemia (e.g., acute lymphoblastic leukemia, acute myeloid leukemia, chronic lymphocytic leukemia, chronic myelogenous leukemia), liver cancer, lung cancer, lymphoma (e.g., AIDS-related lymphoma, Burkitt lymphoma, cutaneous T cell lymphoma, Hogkin lymphoma, Non-Hogkin lymphoma, primary central nervous system lymphoma), malignant mesothelioma, multiple myeloma, myelodysplastic syndrome, nasal cavity cancer, paranasal sinus cancer, nasopharyngeal cancer, neuroblastoma, oral cavity cancer, oropharyngeal cancer, osteosarcoma, ovarian cancer, pancreatic cancer, penile cancer, pituitary tumors, prostate cancer, retinoblastoma, rhabdomyo sarcoma, rhabdoid tumor, salivary gland cancer, sarcoma, skin cancer (e.g., basal cell carcinoma, melanoma), small intestine cancer, stomach cancer, teratoid tumor, testicular cancer, throat cancer, thymus cancer, thyroid cancer, unusual childhood cancers, urethral cancer, uterine cancer, uterine sarcoma, vaginal cancer, vulvar cancer, Waldenström macroglobulinemia, and Wilms tumor. In some embodiments, the symptom(s) associated thereof include, but are not limited to, anemia, loss of appetite, irritation of bladder lining, bleeding and bruising (thrombocytopenia), changes in taste or smell, constipation, diarrhea, dry mouth, dysphagia, edema, fatigue, hair loss (alopecia), infection, infertility, lymphedema, mouth sores, nausea, pain, peripheral neuropathy, tooth decay, urinary tract infections, and/or problems with memory and concentration.

The method may comprise preparing a pharmaceutical composition with at least one genetically engineered species, strain, or subtype of bacteria described herein, and administering the pharmaceutical composition to a subject in a therapeutically effective amount. The genetically engineered microorganisms may be administered locally, e.g., intratumorally or peritumorally into a tissue or supplying vessel, or systemically, e.g., intravenously by infusion or injection. In some embodiments, the genetically engineered bacteria are administered intravenously, intratumorally, intra-arterially, intramuscularly, intraperitoneally, orally, or topically. In some embodiments, the genetically engineered microorganisms are administered intravenously, i.e., systemically.

In certain embodiments, administering the pharmaceutical composition to the subject reduces cell proliferation, tumor growth, and/or tumor volume in a subject. In some embodiments, the methods of the present disclosure may reduce cell proliferation, tumor growth, and/or tumor volume by at least about 10%, 20%, 25%, 30%, 40%, 50%, 60%, 70%, 75%, 80%, 85%, 90%, 95%, or more as compared to levels in an untreated or control subject. In some embodiments, reduction is measured by comparing cell proliferation, tumor growth, and/or tumor volume in a subject before and after administration of the pharmaceutical composition. In some embodiments, the method of treating or ameliorating a cancer in a subject allows one or more symptoms of the cancer to improve by at least about 10%, 20%, 30%, 40%, 50%, 60%, 70%, 80%, 90%, 95%, or more.

Before, during, and after the administration of the pharmaceutical composition, cancerous cells and/or biomarkers in a subject may be measured in a biological sample, such as blood, serum, plasma, urine, peritoneal fluid, and/or a biopsy from a tissue or organ. In some embodiments, the methods may include administration of the compositions of the invention to reduce tumor volume in a subject to an undetectable size, or to less than about 1%, 2%, 5%, 10%, 20%, 25%, 30%, 40%, 50%, 60%, 70%, 75%, 80%, or 90% of the subject's tumor volume prior to treatment. In other embodiments, the methods may include administration of the compositions of the invention to reduce the cell proliferation rate or tumor growth rate in a subject to an undetectable rate, or to less than about 1%, 2%, 5%, 10%, 20%, 25%, 30%, 40%, 50%, 60%, 70%, 75%, 80%, or 90% of the rate prior to treatment.

For genetically engineered microorganisms expressing immune-based anti-cancer molecules, e.g., a single-chain CTLA-4 antibody, responses patterns may be different than for traditional cytotoxic therapies. For example, tumors treated with immune-based therapies may enlarge before they regress, and/or new lesions may appear (Agarwala et al., 2015). Increased tumor size may be due to heavy infiltration with lymphocytes and macrophages that are normally not present in tumor tissue. Additionally, response times may be slower than response times associated with standard therapies, e.g., cytotoxic therapies. In some embodiments, delivery of the anti-cancer molecule may modulate the growth of a subject's tumor and/or ameliorate the symptoms of a cancer while temporarily increasing the volume and/or size of the tumor.

The genetically engineered bacteria may be destroyed, e.g., by defense factors in tissues or blood serum (Sonnenborn et al., 2009), or by activation of a kill switch, several hours or days after administration. Thus, the pharmaceutical composition comprising the gene or gene cassette for producing the anti-cancer molecule may be re-administered at a therapeutically effective dose and frequency. In alternate embodiments, the genetically engineered bacteria are not destroyed within hours or days after administration and may propagate and colonize the tumor.

The pharmaceutical composition may be administered alone or in combination with one or more additional therapeutic agents, e.g., a chemotherapeutic drug such a methotrexate. An important consideration in selecting the one or more additional therapeutic agents is that the agent(s) should be compatible with the genetically engineered bacteria of the invention, e.g., the agent(s) must not kill the bacteria. In some studies, the efficacy of anticancer immunotherapy, e.g., CTLA-4 or PD-1 inhibitors, requires the presence of particular bacterial strains in the microbiome (Ilda et al., 2013; Vetizou et al., 2015; Sivan et al., 2015). In some embodiments, the pharmaceutical composition is administered with one or more commensal or probiotic bacteria, e.g., *Bifidobacterium* or *Bacteroides*.

In some embodiments, the genetically engineered bacteria are administered sequentially, simultaneously, or subsequently to dosing with one or more chemotherapeutic agents selected from Trabectedin®, Belotecan®, Cisplatin®, Carboplatin®, Bevacizumab®, Pazopanib®, 5-Fluorouracil, Capecitabine®, Irinotecan®, and Oxaliplatin®. In some embodiments, the genetically engineered bacteria are administered sequentially, simultaneously, or subsequently to dosing with Gemcitabine (Gemzar).

In a non-limiting example one or more genetically engineered bacteria comprising gene sequence(s) encoding one or more adenosine degradation enzyme(s) described herein are administered sequentially, simultaneously, or subsequently to dosing with one or more chemotherapeutic reagents described herein. In a non-limiting example, one or more engineered bacteria described herein which comprise gene sequence(s) encoding anti-CD40 antibody for production and secretion of anti-CD40 antibody into the extracellular environment, are administered sequentially, simultaneously, or subsequently to dosing with one or more chemotherapeutic reagents described herein. In another non-limiting example, one or more engineered bacteria described herein which comprise gene sequence(s) encoding anti-CD40 antibody for production and display of anti-CD40 antibody on the bacterial cell surface facing into the extracellular environment, are administered sequentially, simultaneously, or subsequently to dosing with one or more chemotherapeutic reagents described herein. In a non-limiting example, one or more engineered bacteria described herein which comprise gene sequence(s) encoding anti-CD40 antibody for production and secretion of anti-CD40 antibody into the extracellular environment in combination with gene sequence(s) encoding enzymes for the degradation of adenosine, are administered sequentially, simultaneously, or subsequently to dosing with one or more chemotherapeutic reagents described herein. In a non-limiting example, one or more engineered bacteria described herein which comprise gene sequence(s) encoding anti-CD40 antibody for production and display of anti-CD40 antibody on the cell surface facing into the extracellular environment in combination with gene sequence(s) encoding enzymes for the degradation of adenosine, are administered sequentially, simultaneously, or subsequently to dosing with one or more chemotherapeutic reagents described herein. In one embodiment, the genetically engineered bacteria comprising gene sequences encoding one or more adenosine degradation enzyme(s) and/or an anti-CD40 secretion and/or anti-CD40 display circuit, alone or in combination with one or more chemotherapeutic reagents described herein are administered for the treatment, management or prevention of pancreatic ductal adenocarcinoma. In these embodiments, the one or more chemotherapeutic reagent is administered systemically and/or orally and/or intratumorally.

In a non-limiting example one or more genetically engineered bacteria comprising gene sequence(s) encoding one or more adenosine degradation enzyme(s) described herein are administered sequentially, simultaneously, or subsequently to dosing with Gemcitabine. In a non-limiting example, one or more engineered bacteria described herein which comprise gene sequence(s) encoding anti-CD40 antibody for production and secretion of anti-CD40 antibody into the extracellular environment, are administered sequentially, simultaneously, or subsequently to dosing with Gemcitabine. In another non-limiting example, one or more engineered bacteria described herein which comprise gene sequence(s) encoding anti-CD40 antibody for production and display of anti-CD40 antibody on the bacterial cell surface facing into the extracellular environment, are administered sequentially, simultaneously, or subsequently to dosing with Gemcitabine. In a non-limiting example, one or more engineered bacteria described herein which comprise gene sequence(s) encoding anti-CD40 antibody for production and secretion of anti-CD40 antibody into the extracellular environment in combination with gene sequence(s) encoding enzymes for the degradation of adenosine, are administered sequentially, simultaneously, or subsequently to dosing with Gemcitabine. In a non-limiting example, one or more engineered bacteria described herein which comprise gene sequence(s) encoding anti-CD40 antibody for production and display of anti-CD40 antibody on the cell surface facing into the extracellular environment in combination with gene sequence(s) encoding enzymes for the degradation of adenosine, are administered sequentially, simultaneously, or subsequently to dosing with Gemcitabine. In one embodiment, the genetically engineered bacteria comprising gene sequence(s) one or more adenosine degradation enzyme(s) and/or an anti-CD40 secretion and/or anti-CD40 display circuit, alone or in combination with Gemcitabine are administered for the treatment, management or prevention of pancreatic ductal adenocarcinoma. In these embodiments, Gemcitabine is administered systemically and/or orally and/or intratumorally.

In some embodiments, the at least one bacterial cell is administered sequentially, simultaneously, or subsequently to dosing with one or more of the following checkpoint inhibitors or other antibodies known in the art or described herein. Non-limiting examples include CTLA-4 antibodies (including but not limited to Ipilimumab and Tremelimumab (CP675206)), anti-4-1BB (CD137, TNFRSF9) antibodies (including but not limited to PF-05082566, and Urelumab), anti CD134 (OX40) antibodies, including but not limited to Anti-OX40 antibody (Providence Health and Services), anti-PD1 antibodies (including but not limited to Nivolumab, Pidilizumab, Pembrolizumab (MK-3475/SCH900475, lambrolizumab, REGN2810, PD1 (Agenus)), anti-PD-L1 antibodies (including but not limited to Durvalumab (MEDI4736), Avelumab (MSB0010718C), and Atezolizumab (MPDL3280A, RG7446, RO5541267)), and it-KIR antibodies (including but not limited to Lirilumab), LAG3 antibodies (including but not limited to BMS-986016), anti-CCR4 antibodies (including but not limited to Mogamulizumab), anti-CD27 antibodies (including but not limited to Varlilumab), anti-CXCR4 antibodies (including but not limited to Ulocuplumab). In some embodiments, the at least one bacterial cell is administered sequentially, simultaneously, or subsequently to dosing with an anti-phophatidyl serine antibody (including but not limited to Bavituxumab).

In some embodiments, the at least one bacterial cell is administered sequentially, simultaneously, or subsequently to dosing with one or more antibodies selected from TLR9 antibody (including, but not limited to, MGN1703 PD1 antibody (including, but not limited to, SHR-1210 (Incyte/Jiangsu Hengrui)), anti-OX40 antibody (including, but not limited to, OX40 (Agenus)), anti-Tim3 antibody (including, but not limited to, Anti-Tim3 (Agenus/INcyte)), anti-Lag3 antibody (including, but not limited to, Anti-Lag3 (Agenus/INcyte)), anti-B7H3 antibody (including, but not limited to, Enoblituzumab (MGA-271), anti-CT-011 (hBAT, hBAT1) as described in WO2009101611, anti-PDL-2 antibody (including, but not limited to, AMP-224 (described in WO2010027827 and WO2011066342)), anti-CD40 antibody (including, but not limited to, CP-870, 893), anti-CD40 antibody (including, but not limited to, CP-870, 893).

In a non-limiting example, one or more engineered bacteria described herein, which comprise gene sequence(s) encoding anti-CD47 antibody for production and secretion of anti-CD47 antibody into the extracellular environment, are administered sequentially, simultaneously, or subsequently to dosing with an anti-PD1 antibody. In a non-limiting example, one or more engineered bacteria described herein, which comprise gene sequence(s) encoding anti-CD47 antibody for production and display of anti-CD47 antibody on the cell surface facing into the extracellular environment, are administered sequentially, simultaneously, or subsequently to dosing with an anti-PD1 antibody. In a non-limiting example, one or more engineered bacteria described herein, which comprise gene sequence(s) encoding enzymes for the production of arginine, are administered sequentially, simultaneously, or subsequently to dosing with an anti-PD1 antibody. Non-limiting examples of such anti-PD1 antibodies are described herein. In a non-limiting example, one or more engineered bacteria described herein, which comprise gene sequence(s) encoding anti-CD47 antibody for production and secretion of anti-CD47 antibody into the extracellular environment in combination with gene sequence(s) encoding enzymes for the production of arginine, are administered sequentially, simultaneously, or subsequently to dosing with an anti-PD1 antibody. In a non-limiting example, one or more engineered bacteria described herein, which comprise gene sequence(s) encoding anti-CD47 antibody for production and display of anti-CD47 antibody on the cell surface facing into the extracellular environment in combination with gene sequence(s) encoding enzymes for the production of arginine, are administered sequentially, simultaneously, or subsequently to dosing with an anti-PD1 antibody. In one embodiment, such a regimen comprising a genetically engineered bacterium which comprises circuitry for the production of arginine and/or for the secretion of anti-CD47, alone or in combination with a PD-1 antibody, e.g., nivolumab and/or pebrolizumab, is used for the treatment, management and/or prevention of advanced solid tumors. In some embodiments, the genetically engineered bacteria for the treatment of advanced solid tumors are administered orally. In some embodiments, the genetically engineered bacteria for the treatment of advanced solid tumors are administered systemically. In some embodiments, the genetically engineered bacteria for the treatment of advanced solid tumors are administered intratumorally. In these embodiments, the anti-PD-1 antibody is administered systemically and/or orally and/or intratumorally.

In a non-limiting example, one or more engineered bacteria described herein, which comprise gene sequence(s) encoding one or more cytokine(s) described herein for production and secretion of one or more cytokine(s) into the extracellular environment, are administered sequentially, simultaneously, or subsequently to dosing with an anti-PD1 antibody. In a non-limiting example, one or more engineered bacteria described herein, which comprise gene sequence(s) encoding one or more cytokine(s) described herein for production and display of one or more cytokine(s) described herein on the cell surface facing into the extracellular environment, are administered sequentially, simultaneously, or subsequently to dosing with an anti-PD1 antibody. In a non-limiting example, one or more engineered bacteria described herein, which comprise gene sequence(s) encoding one or more enzymes for the degradation of kynurenine and/or the production of tryptophan, are administered sequentially, simultaneously, or subsequently to dosing with an anti-PD1 antibody. Non-limiting examples of such anti-PD1 antibodies are described herein. In a non-limiting example, one or more engineered bacteria described herein, which comprise gene sequence(s) encoding one or more cytokine(s) described herein for production and secretion of one or more cytokine(s) into the extracellular environment in combination with gene sequence(s) encoding one or more enzymes for the degradation of kynurenine and/or the production of tryptophan, are administered sequentially, simultaneously, or subsequently to dosing with an anti-PD1 antibody. In a non-limiting example, one or more engineered bacteria described herein, which comprise gene sequence(s) encoding one or more cytokine(s) described herein for production and display of one or more cytokine(s) described herein on the cell surface facing into the extracellular environment in combination with gene sequence(s) encoding encoding one or more enzymes for the degradation of kynurenine and/or the production of tryptophan, are administered sequentially, simultaneously, or subsequently to dosing with an anti-PD1 antibody. Non-limiting examples of such anti-PD-L1 and/or PD-1 antibodies are described herein, and include but are not limited to, Keytruda (pembrolizumab, anti-PD-1), Optivo (nivolumab, anti-PD1), and Tecentriq (Atezolizumab, anti-PD-L1). In these embodiments, the anti-PD-1 antibody is administered systemically and/or orally and/or intratumorally. In one embodiment, such a regimen comprising a genetically engineered bacterium which produces one or more enzymes for the degradation of kynurenine and/or the production of tryptophan for the degradation of kynurenine and/or secretes one or more cytokine(s) described herein, alone or in combination with a PD-1 antibody, e.g., nivolumab and/or pebrolizumab, is used for the treatment, management and/or prevention of colorectal carcinoma. In one embodiment, the administration of the genetically engineered bacterium is oral for the treatment of colorectal carcinoma. In one embodiment, the administration of the genetically engineered bacterium is systemic for the treatment of colorectal carcinoma. In one embodiment, the administration of the genetically engineered bacterium is intratumoral for the treatment of colorectal carcinoma. In one embodiment, such a regimen comprising a genetically engineered bacterium which produces one or more enzymes for the degradation of kynurenine and/or the production of tryptophan for the degradation of kynurenine and/or secretes one or more cytokine(s) described herein, alone or in combination with a PD-1 antibody, e.g., nivolumab and/or pembrolizumab, is used for the treatment, management and/or prevention of hepatocellular carcinoma. In one embodiment, the administration of the genetically engineered bacterium is oral for the treatment of hepatocellular carcinoma. In one embodiment, the administration of the genetically engineered bacterium is systemic for the treatment of hepatocellular carcinoma. In one embodiment, the administration of the genetically engineered bacterium is intratumoral for the treatment of hepatocellular carcinoma. In one embodiment, such a regimen comprising a genetically engineered bacterium which produces one or more enzymes for the degradation of kynurenine and/or the production of tryptophan for the degradation of kynurenine and/or secretes one or more cytokine(s) described herein, alone or in combination with a PD-1 antibody, e.g., nivolumab and/or pebrolizumab, is used for the treatment, management and/or prevention of immunotherapy-refractory advanced melanoma. In one embodiment, the administration of the genetically engineered bacterium is oral for the treatment of advanced melanoma. In one embodiment, the administration of the genetically engineered bacterium is intratumoral for the treatment of advanced melanoma. In one embodiment, the administration of the genetically engineered bacterium is systemic for the treatment of advanced melanoma.

In a non-limiting example, one or more engineered bacteria described herein, which comprise gene sequence(s) encoding IL-15 for production and secretion of IL-15 into the extracellular environment, are administered sequentially, simultaneously, or subsequently to dosing with an anti-PD1 antibody. In a non-limiting example, one or more engineered bacteria described herein, which comprise gene sequence(s) encoding IL-15 for production and display of IL-15 on the cell surface facing into the extracellular environment, are administered sequentially, simultaneously, or subsequently to dosing with an anti-PD1 antibody. In a non-limiting example, one or more engineered bacteria described herein, which comprise gene sequence(s) encoding kynureninase, are administered sequentially, simultaneously, or subsequently to dosing with an anti-PD1 antibody. Non-limiting examples of such anti-PD1 antibodies are described herein. In a non-limiting example, one or more engineered bacteria described herein, which comprise gene sequence(s) encoding IL-15 for production and secretion of IL-15 into the extracellular environment in combination with gene sequence(s) encoding kynureninase, are administered sequentially, simultaneously, or subsequently to dosing with an anti-PD1 antibody. In a non-limiting example, one or more engineered bacteria described herein, which comprise gene sequence(s) encoding IL-15 for production and display of IL-15 on the cell surface facing into the extracellular environment in combination with gene sequence(s) encoding encoding kynureninase, are administered sequentially, simultaneously, or subsequently to dosing with an anti-PD1 antibody. Non-limiting examples of such anti-PD-L1 and/or PD-1 antibodies are described herein, and include but are not limited to, Keytruda (pembrolizumab, anti-PD-1), Optivo (nivolumab, anti-PD1), and Tecentriq (Atezolizumab, anti-PD-L1). In one embodiment, such a regimen comprising a genetically engineered bacterium which produces kynureninase for the degradation of kynurenine and/or secretes IL-15, alone or in combination with a PD-1 antibody, e.g., nivolumab and/or pebrolizumab, is used for the treatment, management and/or prevention of colorectal carcinoma. In one embodiment, the administration of the genetically engineered bacterium is oral for the treatment of colorectal carcinoma. In one embodiment, the administration of the genetically engineered bacterium is systemic for the treatment of colorectal carcinoma. In one embodiment, the administration of the genetically engineered bacterium is intratumoral for the treatment of colorectal carcinoma. In one embodiment, such a regimen comprising a genetically engineered bacterium which produces kynureninase for the degradation of kynurenine and/or secretes IL-15, alone or in combination with a PD-1 antibody, e.g., nivolumab and/or pebrolizumab, is used for the treatment, management and/or prevention of hepatocellular carcinoma. In one embodiment, the administration of the genetically engineered bacterium is oral for the treatment of hepatocellular carcinoma. In one embodiment, the administration of the genetically engineered bacterium is systemic for the treatment of hepatocellular carcinoma. In one embodiment, the administration of the genetically engineered bacterium is intratumoral for the treatment of hepatocellular carcinoma. In one embodiment, such a regimen comprising a genetically engineered bacterium which produces kynureninase for the degradation of kynurenine and/or secretes IL-15, alone or in combination with a PD-1 antibody, e.g., nivolumab and/or pebrolizumab, is used for the treatment, management and/or prevention of immunotherapy-refractory advanced melanoma. In one embodiment, the administration of the genetically engineered bacterium is oral for the treatment of advanced melanoma. In one embodiment, the administration of the genetically engineered bacterium is intratumoral for the treatment of advanced melanoma. In one embodiment, the administration of the genetically engineered bacterium is systemic for the treatment of advanced melanoma. In these embodiments, the anti-PD-1 antibody is administered systemically and/or orally and/or intratumorally.

In a non-limiting example, one or more engineered bacteria described herein, which comprise gene sequence(s) encoding anti-CD47 antibody for production and secretion of anti-CD47 antibody into the extracellular environment, are administered sequentially, simultaneously, or subsequently to dosing with an anti-PD-L1 antibody. In a non-limiting example, one or more engineered bacteria described herein, which comprise gene sequence(s) encoding anti-CD47 antibody for production and display of anti-CD47 antibody on the cell surface facing into the extracellular environment, are administered sequentially, simultaneously, or subsequently to dosing with an anti-PD-L1 antibody. In a non-limiting example, one or more engineered bacteria described herein, which comprise gene sequence(s) encoding enzymes for the production of arginine, are administered sequentially, simultaneously, or subsequently to dosing with an anti-PD-L1 antibody. Non-limiting examples of such anti-PD1 antibodies are described herein. In a non-limiting example, one or more engineered bacteria described herein, which comprise gene sequence(s) encoding anti-CD47 antibody for production and secretion of anti-CD47 antibody into the extracellular environment in combination with gene sequence(s) encoding enzymes for the production of arginine, are administered sequentially, simultaneously, or subsequently to dosing with an anti-PD-L1 antibody. In a non-limiting example, one or more engineered bacteria described herein, which comprise gene sequence(s) encoding anti-CD47 antibody for production and display of anti-CD47 antibody on the cell surface facing into the extracellular environment in combination with gene sequence(s) encoding enzymes for the production of arginine, are administered sequentially, simultaneously, or subsequently to dosing with an anti-PD-L1 antibody. Non-limiting examples of such anti-PD1 antibodies are described herein. In one embodiment, such a regimen comprising a genetically engineered bacterium which comprises circuitry for the production of arginine and/or for the secretion of anti-CD47, alone or in combination with a PD-L1 antibody, e.g., nivolumab and/or pebrolizumab, is used for the treatment, management and/or prevention of advanced solid tumors. In some embodiments, the genetically engineered bacteria for the treatment of advanced solid tumors are administered orally. In some embodiments, the genetically engineered bacteria for the treatment of advanced solid tumors are administered systemically. In some embodiments, the genetically engineered bacteria for the treatment of advanced solid tumors are administered intratumorally. In these embodiments, the antiPD-L1 antibody is administered systemically and/or orally and/or intratumorally. In one embodiment, such a regimen comprising a genetically engineered bacterium which produces one or more enzymes for the degradation of kynurenine and/or the production of tryptophan for the degradation of kynurenine and/or secretes one or more cytokine(s) described herein, alone or in combination with a PD-L1 antibody, e.g., nivolumab and/or pebrolizumab, is used for the treatment, management and/or prevention of colorectal carcinoma. In one embodiment, the administration of the genetically engineered bacterium is oral for the treatment of colorectal carcinoma. In one embodiment, the administration of the genetically engineered bacterium is systemic for the treatment of colorectal carcinoma. In one embodiment, the administration of the genetically engineered bacterium is intratumoral for the treatment of colorectal carcinoma. In one embodiment, such a regimen comprising a genetically engineered bacterium which produces one or more enzymes for the degradation of kynurenine and/or the production of tryptophan for the degradation of kynurenine and/or secretes one or more cytokine(s) described herein, alone or in combination with a PD-L1 antibody, e.g., nivolumab and/or pebrolizumab, is used for the treatment, management and/or prevention of hepatocellular carcinoma. In one embodiment, the administration of the genetically engineered bacterium is oral for the treatment of hepatocellular carcinoma. In one embodiment, the administration of the genetically engineered bacterium is systemic for the treatment of hepatocellular carcinoma. In one embodiment, the administration of the genetically engineered bacterium is intratumoral for the treatment of hepatocellular carcinoma. In one embodiment, such a regimen comprising a genetically engineered bacterium which produces one or more enzymes for the degradation of kynurenine and/or the production of tryptophan for the degradation of kynurenine and/or secretes one or more cytokine(s) described herein, alone or in combination with a PD-L1 antibody, e.g., nivolumab and/or pebrolizumab, is used for the treatment, management and/or prevention of immunotherapy-refractory advanced melanoma. In one embodiment, the administration of the genetically engineered bacterium is oral for the treatment of advanced melanoma. In one embodiment, the administration of the genetically engineered bacterium is intratumoral for the treatment of advanced melanoma. In one embodiment, the administration of the genetically engineered bacterium is systemic for the treatment of advanced melanoma.

In a non-limiting example, one or more engineered bacteria described herein, which comprise gene sequence(s) encoding one or more cytokine(s) described herein for production and secretion of one or more cytokine(s) into the extracellular environment, are administered sequentially, simultaneously, or subsequently to dosing with an anti-PD-L1 antibody. In a non-limiting example, one or more engineered bacteria described herein, which comprise gene sequence(s) encoding one or more cytokine(s) described herein for production and display of one or more cytokine(s) described herein on the cell surface facing into the extracellular environment, are administered sequentially, simultaneously, or subsequently to dosing with an anti-PD-L1 antibody. In a non-limiting example, one or more engineered bacteria described herein, which comprise gene sequence(s) encoding one or more enzymes for the degradation of kynurenine and/or the production of tryptophan, are administered sequentially, simultaneously, or subsequently to dosing with an anti-PD-L1 antibody. Non-limiting examples of such anti-PD1 antibodies are described herein. In a non-limiting example, one or more engineered bacteria described herein, which comprise gene sequence(s) encoding one or more cytokine(s) described herein for production and secretion of one or more cytokine(s) into the extracellular environment in combination with gene sequence(s) encoding one or more enzymes for the degradation of kynurenine and/or the production of tryptophan, are administered sequentially, simultaneously, or subsequently to dosing with an anti-PD-L1 antibody. In a non-limiting example, one or more engineered bacteria described herein, which comprise gene sequence(s) encoding one or more cytokine(s) described herein for production and display of one or more cytokine(s) described herein on the cell surface facing into the extracellular environment in combination with gene sequence(s) encoding encoding one or more circuits for the degradation of kynurenine and/or the production of tryptophan, are administered sequentially, simultaneously, or subsequently to dosing with an anti-PD-L1 antibody. Non-limiting examples of such anti-PD-L1 and/or PD-1 antibodies are described herein, and include but are not limited to, Keytruda (pembrolizumab, anti-PD-1), Optivo (nivolumab, anti-PD1), and Tecentriq (Atezolizumab, anti-PD-L1). In these embodiments, the anti-PD-L1 antibody is administered systemically and/or orally and/or intratumorally.

In a non-limiting example, one or more engineered bacteria described herein, which comprise gene sequence(s) encoding IL-15 for production and secretion of IL-15 into the extracellular environment, are administered sequentially, simultaneously, or subsequently to dosing with an anti-PD-L1 antibody. In a non-limiting example, one or more engineered bacteria described herein, which comprise gene sequence(s) encoding IL-15 for production and display of IL-15 on the cell surface facing into the extracellular environment, are administered sequentially, simultaneously, or subsequently to dosing with an anti-PD-L1 antibody. In a non-limiting example, one or more engineered bacteria described herein, which comprise gene sequence(s) encoding kynureninase, are administered sequentially, simultaneously, or subsequently to dosing with an anti-PD-L1 antibody. Non-limiting examples of such anti-PD1 antibodies are described herein. In a non-limiting example, one or more engineered bacteria described herein, which comprise gene sequence(s) encoding IL-15 for production and secretion of IL-15 into the extracellular environment in combination with gene sequence(s) encoding kynureninase, are administered sequentially, simultaneously, or subsequently to dosing with an anti-PD-L1 antibody. In a non-limiting example, one or more engineered bacteria described herein, which comprise gene sequence(s) encoding IL-15 for production and display of IL-15 on the cell surface facing into the extracellular environment in combination with gene sequence(s) encoding encoding kynureninase, are administered sequentially, simultaneously, or subsequently to dosing with an anti-PD-L1 antibody. Non-limiting examples of such anti-PD-L1 and/or PD-1 antibodies are described herein, and include but are not limited to, Keytruda (pembrolizumab, anti-PD-1), Optivo (nivolumab, anti-PD1), and Tecentriq (Atezolizumab, anti-PD-L1). In one embodiment, such a regimen comprising a genetically engineered bacterium which produces kynureninase for the degradation of kynurenine and/or secretes IL-15, alone or in combination with a PD-L1 antibody, e.g., nivolumab and/or pebrolizumab, is used for the treatment, management and/or prevention of colorectal carcinoma. In one embodiment, the administration of the genetically engineered bacterium is oral for the treatment of colorectal carcinoma. In one embodiment, the administration of the genetically engineered bacterium is systemic for the treatment of colorectal carcinoma. In one embodiment, the administration of the genetically engineered bacterium is intratumoral for the treatment of colorectal carcinoma. In one embodiment, such a regimen comprising a genetically engineered bacterium which produces kynureninase for the degradation of kynurenine and/or secretes IL-15, alone or in combination with a PD-L1 antibody, e.g., nivolumab and/or pebrolizumab, is used for the treatment, management and/or prevention of hepatocellular carcinoma. In one embodiment, the administration of the genetically engineered bacterium is oral for the treatment of hepatocellular carcinoma. In one embodiment, the administration of the genetically engineered bacterium is systemic for the treatment of hepatocellular carcinoma. In one embodiment, the administration of the genetically engineered bacterium is intratumoral for the treatment of hepatocellular carcinoma. In one embodiment, such a regimen comprising a genetically engineered bacterium which produces kynureninase for the degradation of kynurenine and/or secretes IL-15, alone or in combination with a PD-L1 antibody, e.g., nivolumab and/or pebrolizumab, is used for the treatment, management and/or prevention of immunotherapy-refractory advanced melanoma. In one embodiment, the administration of the genetically engineered bacterium is oral for the treatment of advanced melanoma. In one embodiment, the administration of the genetically engineered bacteria is intratumoral for the treatment of advanced melanoma. In one embodiment, the administration of the genetically engineered bacteria is systemic for the treatment of advanced melanoma. In these embodiments, the antiPD-L1 antibody is administered systemically and/or orally and/or intratumorally.

In some embodiments, the PD-1 antibodies administered in combination with the genetically engineered bacteria are administered systemically. In some embodiments, the PD-L1 antibodies administered in combination with the genetically engineered bacteria are administered are administered systemically. In some embodiments, the PD-1 antibodies administered in combination with the genetically engineered bacteria are administered are administered intratumorally. In some embodiments, the PD-L1 antibodies administered in combination with the genetically engineered bacteria are administered are administered intratumorally. In some embodiments, the PD-1 antibodies administered in combination with the genetically engineered bacteria are administered are administered orally. In some embodiments, the PD-L1 antibodies are administered orally.

In some embodiments, the genetically engineered bacteria are administered systemically. In some embodiments, the genetically engineered bacteria are administered intratumorally. In some embodiments, the genetically engineered bacteria are administered orally.

In some embodiments, the genetically engineered bacteria are administered intratumorally and the PD-1 antibodies are administered systemically. In some embodiments, the genetically engineered bacteria are administered intratumorally and the PD-L1 antibodies are administered systemically. In some embodiments, the genetically engineered bacteria are administered intratumorally and the PD-1 antibodies are administered intratumorally. In some embodiments, the genetically engineered bacteria are administered intratumorally and the PD-L1 antibodies are administered intratumorally. In some embodiments, the genetically engineered bacteria are administered intratumorally and the PD-1 antibodies are administered orally. In some embodiments, the PD-L1 antibodies are administered orally.

In some embodiments, the genetically engineered bacteria are administered systemically and the PD-1 antibodies are administered systemically. In some embodiments, the genetically engineered bacteria are administered systemically and the PD-L1 antibodies are administered systemically. In some embodiments, the th genetically engineered bacteria are administered systemically and PD-1 antibodies are administered intratumorally. In some embodiments, the genetically engineered bacteria are administered systemically and the PD-L1 antibodies are administered intratumorally. In some embodiments, the genetically engineered bacteria are administered systemically and the PD-1 antibodies are administered orally. In some embodiments, the genetically engineered bacteria are administered systemically and the PD-L1 antibodies are administered orally.

In some embodiments, the genetically engineered bacteria are administered orally and the PD-1 antibodies are administered systemically. In some embodiments, the genetically engineered bacteria are administered and orally the PD-L1 antibodies are administered systemically. In some embodiments, the genetically engineered bacteria are administered orally and the PD-1 antibodies are administered intratumorally. In some embodiments, the genetically engineered bacteria are administered orally and the PD-L1 antibodies are administered intratumorally. In some embodiments, the genetically engineered bacteria are administered orally and the PD-1 antibodies are administered orally. In some embodiments, the genetically engineered bacteria are administered orally and the PD-L1 antibodies are administered orally.

In some embodiments, the genetically engineered microorganisms may be administered as part of a regimen, which includes other treatment modalities or combinations of other modalities. Non-limiting examples of these modalities or agents are conventional therapies (e.g., radiotherapy, chemotherapy), other immunotherapies, stem cell therapies, and targeted therapies, (e.g., BRAF or vascular endothelial growth factor inhibitors; antibodies or compounds), bacteria described herein, and oncolytic viruses. Therapies also include related to antibody-immune engagement, including Fc-mediated ADCC therapies, therapies using bispecific soluble scFvs linking cytotoxic T cells to tumor cells (e.g., BiTE), and soluble TCRs with effector functions. Immunotherapies include vaccines (e.g., viral antigen, tumor associated antigen, neoantigen, or combinations thereof), checkpoint inhibitors, cytokine therapies, adoptive cellular therapy (ACT). ACT includes but is not limited to, tumor infiltrating lymphocyte (TIL) therapies, native or engineered TCR or CAR-T therapies, natural killer cell therapies, and dendritic cell vaccines or other vaccines of other antigen presenting cells. Targeted therapies include antibodies and chemical compounds, and include for example antiangiogenic strategies and BRAF inhibition.

In one embodiment, the genetically engineered microorganism is an oncolytic virus. In some embodiments, the genetically engineered OV is delivered in combination with vaccines, chemotherapy, radiotherapy, checkpoint inhibitors, chemoradiotherapy, anti-angiogenic therapy, monoclonal antibodies, adoptive cell transfer, cytokines, chemokines, other OVs and any of the modalities mentioned above.

The immunostimulatory activity of bacterial DNA is mimicked by synthetic oligodeoxynucleotides (ODNs) expressing unmethylated CpG motifs. Bode et al., Expert Rev Vaccines. 2011 April; 10(4): 499-511. CpG DNA as a vaccine adjuvant. When used as vaccine adjuvants, CpG ODNs improve the function of professional antigen-presenting cells and boost the generation of humoral and cellular vaccine-specific immune responses. In some embodiments, CpG can be administered in combination with the genetically engineered bacteria of the invention.

In one embodiment, the genetically engineered microorganisms are administered in combination with tumor cell lysates.

The dosage of the pharmaceutical composition and the frequency of administration may be selected based on the severity of the symptoms and the progression of the cancer. The appropriate therapeutically effective dose and/or frequency of administration can be selected by a treating clinician.

Treatment In Vivo

The genetically engineered bacteria or OV may be evaluated in vivo, e.g., in an animal model. Any suitable animal model of a disease or condition associated with cancer may be used, e.g., a tumor syngeneic or xenograft mouse models (see, e.g., Yu et al., 2015). The genetically engineered bacteria or OV may be administered to the animal systemically or locally, e.g., via oral administration (gavage), intravenous, or subcutaneous injection or via intratumoral injection, and treatment efficacy determined, e.g., by measuring tumor volume.

Non-limiting examples of animal models include mouse models, as described in Dang et al., 2001, Heap et al., 2014 and Danino et al., 2015).

Pre-clinical mouse models determine which immunotherapies and combination immunotherapies will generate the optimal therapeutic index (maximal anti-tumor efficacy and minimal immune related adverse events (irAEs)) in different cancers.

Implantation of cultured cells derived from various human cancer cell types or a patient's tumor mass into mouse tissue sites has been widely used for generations of cancer mouse models (xenograft modeling). In xenograft modeling, human tumors or cell lines are implanted either subcutaneously or orthotopically into immune-compromised host animals (e.g., nude or SCID mice) to avoid graft rejection. Because the original human tumor microenvironment is not recapitulated in such models, the activity of anti-cancer agents that target immune modulators may not be accurately measured in these models, making mouse models with an intact immune system more desirable.

Accordingly, implantation of murine cancer cells in a syngeneic immunocompetent host (allograft) are used to generate mouse models with tumor tissues derived from the same genetic background as a given mouse strain. In syngeneic models, the host immune system is normal, which may more closely represent the real life situation of the tumor's micro-environment. The tumor cells or cancer cell lines are implanted either subcutaneously or orthotopically into the syngeneic immunocompetent host animal (e.g., mouse). Representative murine tumor cell lines, which can be used in syngeneic mouse models for immune checkpoint benchmarking include, but are not limited to the cell lines listed in Table 68.

TABLE 66

Selected cell lines for use in syngeneic mouse models

| Cancer Types | Cell LInes |
| --- | --- |
| Bladder | MBT-2 |
| Breast | 4T1, EMT6, JC |
| Colon | CT-26, Colon26, MC38 |
| Kidney | Renca |
| Leukemia | L1210, C1498 |
| Mastocytoma P815 | P815 |

TABLE 66-continued

Selected cell lines for use in syngeneic mouse models

| Cancer Types | Cell LInes |
| --- | --- |
| Neuroblastoma Neuro -2-A | Neuro-2a |
| Myeloma | MPC-11 |
| Liver | H22 |
| Lung | LL/2, KLN205 |
| Lymphoma | A20, EL4, P388D1, L15178-R, E.G7-OVA |
| Melanoma | B16-BL6, B16-F10, S91 |
| Pancreatic | Pan02 |
| Prostate | RM-1 |
| Fibrosarcoma | WHI-164 |
| Plasmacytoma | J558 |

Additional cell lines include, but are not limited to those in Table 67, which are described with respect to CTLA-4 benchmarking in Joseph F. Grosso and Maria N. Jure-Kunkel et al., 2013, the contents of which is herein incorporated by reference in its entirety.

TABLE 67

Murine cell lines and CTLA-4 antibodies for syngenic mouse models

| Murine Tumor | Tumor type/Mouse strain | Anti-CTLA-4 Ab/Tx regimen |
| --- | --- | --- |
| Brain | SMA-560 Glioma/Vm/Dk) | 9H10; d7* (100 µg), d10 (50 µg), d13 (50 µg) post-implant |
| | GL-261 Glioma/C57BL/6) | 9H10; d0 (100 µg), d3 (50 µg), d6 (50 µg), |
| Ovarian | OV-HM/C57BL/6 × C3H/He) | UC10-4F10-11; 1 mg/mouse |
| Bladder | MB49/C57BL/6 | 9D9; d7, d10, d13 (200 µg each) |
| Sarcoma | Meth-A/BALB/c | 9H10; d6 (100 µg), d9 (50 µg), d12 (50 µg) |
| | MC38, 11A1 BALB/c, C57BL/6 | 9H10; d14 (100 µg), d17 (50 µg), d20 (50 µg) |
| Breast | TSA/BALB/c (62 | 9H10; d12, d14, d16 (200 µg each) |
| | 4T1 BALB/c | 9H10; d14, d18, d21 (200 µg each) |
| | 4T1 BALB/c | 9H10; d14, d18, d21 (200 µg each) |
| | 4T1 BALB/c | UC10-4F10-11; d7, d11, d15, d19 (100 µg each) |
| | SM1/BALB/c | 9H10; d4, d7, d10 (100 µg each) |
| | EMT6/BALB/c | UC10-4F10-11; d4, d8, d12 (400 µg each) Ixa: d3, d7, d11 |
| Colon | MC38/C57BL/6 | UC10-4F10-11; d7, d11, d16 (100 µg each) |
| | MC38 | K4G4, L1B11, L3D10 |
| | CT26 BALB/c | 9H10; d10 (100 µg), d13 (50 µg), d15 (50 µg) |
| | CT26 BALB/c | UC10-4F10-11; d5, d9, d13 (400 µg each) Ixa: d4, d8, d12 |
| | MC38/C57BL/6 | UC10-4F10-11; d14, d21, d28 (800 µg each) |
| Lymphoma | BW5147.3/AKR | UC10-4F10-11; d-1 (250 µg), d0 (250 µg), d4 [100 µg), d8 (100 µg), d12 (100 µg) |
| | EL4/C57BL/6 | 9H10; d3, d5 (100 µg each) |
| Fibrosarcoma | SA1N/A/J | 9H10; every 4 days (200 µg each) |
| | SA1N | UC10-4F10-11; d12, d16, d20 (400 µg each) Ixa: d11, d15, d15 |

TABLE 67-continued

Murine cell lines and CTLA-4 antibodies for syngenic mouse models

| Murine Tumor | Tumor type/Mouse strain | Anti-CTLA-4 Ab/Tx regimen |
| --- | --- | --- |
| Prostata | TRAMP C1[pTC1]/C57BU6 | 9H10; d7, d10, d13 (100 µg each) |
| | TRAMP C2/C57BL/6 | 9H10; d4, d7, d10 (100 µg each) |
| | TRAMP/C57BL | 9H10; 14-16 week old mice d7, d10, d16 post-tR tx (100 µg each) |
| | TRAMP C2/C57BL/6 | 9H10; d29, d33, d40, d50 (100 µg each) d29 = 1d post-cryoablation |
| Melanoma | B16/C57BL/6 | 9H10; d0, d3, d6 (200 µg each) |
| | B16/C57BL/6 | 9H10; d6 (100 µg), d8 [50 µg), d10 (50 µg) |
| | B16/C57BL/6 | 9D9; d3, d6, d9 |
| | B16/C57BL/6 | 9H10; d3, d6, d9 (100 µg each) |
| | B16.F10/C57BL/6 | 9H10; d5 (100 µg), d7 (50 µg), d9 (50 µg) |
| Lung | M109/BALB/c | UC10-4F10-11; d4, d8, d12(400 µg each) Ixa: d3, d7, d11 |
| Plasmacytoma | MOPC-315/BALB/cANnCrlBr | UC10-4F10-11; 20 mm tumors tx daily for 10 days (100 µg each) |

For tumors derived from certain cell lines, ovalbumin can be added to further stimulate the immune response, thereby increasing the response baseline level.

Examples of mouse strains that can be used in syngeneic mouse models, depending on the cell line include C57BL/6, FVB/N, Balb/c, C3H, HeJ, C3H/HeJ, NOD/ShiLT, A/J, 129S1/SvlmJ, NOD. Additionally, several further genetically engineered mouse strains have been reported to mimic human tumorigenesis at both molecular and histologic levels. These genetically engineered mouse models also provide excellent tools to the field and additionally, the cancer cell lines derived from the invasive tumors developed in these models are also good resources for cell lines for syngeneic tumor models Examples of genetically engineered strains are provided in Table 68.

TABLE 68

Exemplary genetic engineered mouse strains of interest

| Animal strain | Strain background | Predicted cancer type |
| --- | --- | --- |
| C57BL/6-Tg(TRAMP)8247Ng/JNju | C57BL/6 | Prostate cancer |
| FVB/N-Tg☐MMTV-PyVT)634Mul/Jnju | FVB/N | Breast cancer |
| C57BL/6J-Apc$^{Min}$/JNju | C57BL/6 | Colorectal cancer |
| STOCK Ptch1$^{tm1\ Mps}$/JNju | C57BL/6JNju | Medulloblastoma |
| NOD-Prkdc$^{em26Cd52}$Il2rg$^{em26Cd22}$Nju | NOD/ShiLt | Not specific |
| C57BL/6J-Apc$^{Min}$/JNju | C57BL/6 | Colorectal cancer |
| BALB/cJNju | BALB/c | Lung cancer |
| C3H/HeJNju (Urethane induced lung cancer model) | C3H/HeJ | Lung cancer |
| A/JNju | A/J | Lung cancer |
| A/Jnju (Urethane induced lung cancer model) | A/J | Lung cancer |
| C3H/HeJSlac | C3H/HeJ | Lung cancer |
| 129S1/SvImJNju (Urethane induced lung cancer model) | 129S1/SvImJ | Lung cancer |
| Kras$^{LSL-G12D/WT}$ | C57BL/6 | Lung cancer |

TABLE 68-continued

Exemplary genetic engineered mouse strains of interest

| Animal strain | Strain background | Predicted cancer type |
|---|---|---|
| Kras$^{LSL-G12D/WT}$; P53$^{KO/KO}$ | C57BL/6 | Lung cancer |
| Pdx1-cre; Kras$^{LSL-G12D/WT}$; P53$^{KO/KO}$ | C57BL/6 | Pancreatic cancer |
| Kras$^{LSL-G12D/WT}$; P16$^{KO/KO}$ | C57BL/6; FVB/N | Pancreaticc cancer; Lung cancer |
| Kras$^{LSL-G12D/WT}$; PTEN$^{CKO/CKO}$ | C57BL/6 | Ovarian cancer; Prostate cancer; Brain cancer |
| Pbsn-cre; Kras$^{LSL-G12D/WT}$; PTEN$^{CKO/CKO}$ | C57BL/6 | Prostate cancer |
| P53$^{KO/KO}$; PTEN$^{CKO/CKO}$ | C57BL/6 | Prostate cancer |
| Pbsn-cre; PTEN$^{CKO/CKO}$ | C57BL/6 | Prostate cancer |
| NOD | NOD | Leukemia |
| B6.Cg-Tg(IghMyc)22Bri/JNju | C57BL/6 | B cell Lymphoma |
| PTEN$^{CKO/CKO}$ | C57BL/6 | Ovarian cancer (Female); Prostate cancer (Male); Tes/s cancer (Male) |
| NASH-HCC (Streptozotocin and high-fat diet induced liver cancer model) | C57BL/6 | Hepatocellular Carcinoma |
| BALB/c nude | BALB/c | Not specific |
| C3H/He | C3H/He | Hepatocellular Carcinoma |
| B6N | C57BL/6 | Not specific |
| B6/N-Akr1c12$^{em1a}$Nju | C57BL/6 | Not specific |
| P53 null from VitalStar | C57BL/6 | Not specific |
| P53 null from VitalStar | C57BL/6 | Not specific |
| P53 null from VitalStar | C57BL/6 | Not specific |
| Pdx1-cre; Kras$^{LSL-G12D/WT}$; p53$^{KO/KO}$ | C57BL/6 | Pancrea/c cancer |
| Kras$^{LSL-G12D/WT}$; P16$^{KO/KO}$ | C57BL/6; FVB/N | Pancrea/c cancer; Lung cancer |
| Kras$^{LSL-G12D/WT}$; PTEN$^{CKO/CKO}$ | C57BL/6 | Ovarian cancer; |
| Kras$^{LSL-G12D/WT}$; PTEN$^{CKO/CKO}$ | C57BL/6 | Prostate cancer; |
| Kras$^{LSL-G12D/WT}$; PTEN$^{CKO/CKO}$ | C57BL/6 | Brain cancer |
| Pbsn-cre; Kras$^{LSL-G12D/WT}$; PTEN$^{CKO/CKO}$ | C57BL/6 | Prostate cancer |
| P53$^{KO/KO}$; PTEN$^{CKO/CKO}$ | C57BL/6 | Prostate cancer |
| Pbsn-cre; PTEN$^{CKO/CKO}$ | C57BL/6 | Prostate cancer |
| Kras$^{LSL-G12D/WT}$ | C57BL/6 | Lung cancer |
| NOD | NOD | Leukemia |
| B6.Cg-Tg(IghMyc)22Bri/JNju | C57BL/6 | B cell Lymphoma |
| PTEN$^{CKO/CKO}$ | C57BL/6 | Ovarian cancer (Female); Prostate cancer (Male); Tes/s cancer (Male) |
| NASH-HCC (Streptozotocin and high-fat diet induced liver cancer model) | C57BL/6 | Hepatocellular Carcinoma |
| BALB/c nude | BALB/c | Not specific |
| C3H/He | C3H/He | Hepatocellular Carcinoma |
| B6N | C57BL/6 | Not specific |
| B6/N-Akr1c12$^{em1a}$Nju | C57BL/6 | Not specific |
| P53 null from VitalStar | C57BL/6 | Not specific |
| P53 null from VitalStar | C57BL/6 | Not specific |
| P53 null from VitalStar | C57BL/6 | Not specific |
| Kras$^{LSL-G12D/WT}$; P53$^{KO/KO}$ | C57BL/6 | Not specific |

Often antibodies directed against human proteins do not detect their murine counterparts. In studying antibodies, including those directed against human immune checkpoint molecules, it is necessary to take this in consideration. For example, Ipilimumab did not show cross-reactivity with or binding to CTLA-4 from rats, mice or rabbits.

In some cases, mice transgenic for the gene of interest can be used to overcome this issue, as was done for ipilimumab. However, in syngeneic mouse models without a human transgene, mouse protein reactive antibodies must be used to test therapeutic antibody strategies. For example, suitable CTLA-4 antibodies for expression by the genetically engineered bacteria of interest include, but are not limited to, 9H10, UC10-4F10-11, 9D9, and K4G4 (Table 67).

More recently, "humanized" mouse models have been developed, in which immunodeficient mice are reconstituted with a human immune system, and which have helped overcome issues relating to the differences between the mouse and human immune systems, allowing the in vivo study of human immunity. Severely immunodeficient mice which combine the IL2receptor null and the severe combined immune deficiency mutation (scid) (NOD-scid IL2Rgnull mice) lack mature T cells, B cells, or functional NK cells, and are deficient in cytokine signaling. These mice can be engrafted with human hematopoietic stem cells and peripheral-blood mononuclear cells. CD34+ hematopoietic stem cells (hu-CD34) are injected into the immune deficient mice, resulting in multi-lineage engraftment of human immune cell populations including very good T cell maturation and function for long-term studies. This model has a research span of 12 months with a functional human immune system displaying T-cell dependent inflammatory responses with no donor cell immune reactivity towards the host. Patient derived xenografts can readily be implanted in these models and the effects of immune modulatory agents studied in an in vivo setting more reflective of the human tumor microenvironment (both immune and non-immune cell-based) (Baia et al., 2015).

Human cell lines of interest for use in the humanized mouse models include but are not limited to HCT-116 and HT-29 colon cancer cell lines.

A rat F98 glioma model and the utility of spontaneous canine tumors, as described in Roberts et al 2014, the contents of each of which are herein incorporated by reference in their entireties. Locally invasive tumors generated by implantation of F98 rat glioma cells engineered to express luciferase were intratumorally injected with *C. novyi*-NT spores, resulting in germination and a rapid fall in luciferase activity. *C. novyi*-NT germination was demonstrated by the appearance of vegetative forms of the bacterium. In these studies, *C. novyi*-NT precisely honed to the tumor sparing neighboring cells.

Canine soft tissue sarcomas for example are common in many breeds and have clinical, histopathological, and genetically features similar to those in humans (Roberts et al, 2014; Staedtke et al., 2015), in particular, in terms of genetic alterations and spectrum of mutations. Roberts et al. conducted a study in dogs, in which *C. novyi*-NT spores were intrtatumorally injected ($1 \times 10^8$ *C. novyi*-NT spores) into spontaneously occurring solid tumors in one to 4 treatment cycles and followed for 90 days. A potent inflammatory response was observed, indicating that the intrattumoral injections mounted an innate immune response.

In some embodiments, the genetically engineered microorganisms of the invention are administered systemically, e.g., orally, subcutaneously, intravenously or intratumorally into any of the models described herein to assess anti-tumor efficacy and any treatment related adverse side effects.

Full Citations

Full citations or the references cited throughout the specification include:
1. Agarwala. Practical approaches to immunotherapy in the clinic. Semin Oncol. 2015 December; 42 Suppl 3:S20-S27. PMID: 26598056.

2. Agata et al. Expression of the PD-1 antigen on the surface of stimulated mouse T and B lymphocytes. Int Immunol. 1996 May; 8(5):765-772. PMID: 8671665.
3. Altenhoefer et al. The probiotic *Escherichia coli* strain Nissle 1917 interferes with invasion of human intestinal epithelial cells by different enteroinvasive bacterial pathogens. FEMS Immunol Med Microbiol. 2004 Apr. 9; 40(3):223-229. PMID: 15039098.
4. Andersen et al. Uracil uptake in *Escherichia coli* K-12: isolation of uraA mutants and cloning of the gene. J Bacteriol. 1995 April; 177(8):2008-2013. PMID: 7721693.
5. Arthur et al. Intestinal inflammation targets cancer-inducing activity of the microbiota. Science. 2012 Oct. 5; 338(6103):120-123. PMID: 22903521.
6. Arai et al. Expression of the nir and nor genes for denitrification of *Pseudomonas aeruginosa* requires a novel CRP/FNR-related transcriptional regulator, DNR, in addition to ANR. FEBS Lett. 1995 Aug. 28; 371(1): 73-76. PMID: 7664887.
7. Bettegowda et al. Overcoming the hypoxic barrier to radiation therapy with anaerobic bacteria. Proc Natl Acad Sci USA. 2003 Dec. 9; 100(25):15083-15088. PMID: 14657371.
8. Brown et al. Exploiting tumour hypoxia in cancer treatment. Nat Rev Cancer. 2004 June; 4(6):437-447. PMID: 15170446.
9. Callura et al. Tracking, tuning, and terminating microbial physiology using synthetic riboregulators. Proc Natl Acad Sci USA. 2010 Sep. 7; 107(36):15898-15903. PMID: 20713708.
10. Castiglione et al. The transcription factor DNR from *Pseudomonas aeruginosa* specifically requires nitric oxide and haem for the activation of a target promoter in *Escherichia coli*. Microbiology. 2009 September; 155(Pt 9):2838-2844. PMID: 19477902.
11. Cronin et al. High resolution in vivo bioluminescent imaging for the study of bacterial tumour targeting." PLoS One. 2012; 7(1):e30940. PMID: 22295120.
12. Cuevas-Ramos et al. *Escherichia coli* induces DNA damage in vivo and triggers genomic instability in mammalian cells. Proc Natl Acad Sci USA. 2010 Jun. 22; 107(25):11537-11542. PMID: 20534522.
13. Dang et al. Combination bacteriolytic therapy for the treatment of experimental tumors. Proc Natl Acad Sci USA. 2001 Dec. 18; 98(26):15155-60. PMID: 11724950.
14. Danino et al. Programmable probiotics for detection of cancer in urine. Sci Transl Med. 2015 May 27; 7(289): 289ra84. PMID: 26019220.
15. Deutscher. The mechanisms of carbon catabolite repression in bacteria. Curr Opin Microbiol. 2008 April; 11(2): 87-93. PMID: 18359269.
16. Dinleyici et al. *Saccharomyces boulardii* CNCM I-745 in different clinical conditions. Expert Opin Biol Ther. 2014 November; 14(11):1593-1609. PMID: 24995675.
17. Eiglmeier et al. Molecular genetic analysis of FNR-dependent promoters. Mol Microbiol. 1989 July; 3(7): 869-878. PMID: 2677602.
18. Follows et al. Study of the interaction of the medium chain mu 2 subunit of the clathrin-associated adapter protein complex 2 with cytotoxic T-lymphocyte antigen 4 and CD28. Biochem J. 2001 Oct. 15; 359(Pt 2):427-434. PMID: 11583591.
19. Forbes. Profile of a bacterial tumor killer. Nat Biotechnol. 2006 December; 24(12):1484-1485. PMID: 17160044.
20. Galimand et al. Positive FNR-like control of anaerobic arginine degradation and nitrate respiration in *Pseudomonas aeruginosa*. J Bacteriol. 1991 March; 173(5):1598-1606. PMID: 1900277.
21. Gardner et al. Construction of a genetic toggle switch in *Escherichia coli*. Nature. 2000; 403:339-342. PMID: 10659857.
22. Gorke et al. Carbon catabolite repression in bacteria: many ways to make the most out of nutrients. Nat Rev Microbiol. 2008 August; 6(8):613-624. PMID: 18628769.
23. Griffin et al. Blockade of T cell activation using a surface-linked single-chain antibody to CTLA-4 (CD152). J Immunol. 2000 May 1; 164(9):4433-42. PMID: 10779742.
24. Groot et al. Functional antibodies produced by oncolytic clostridia. Biochem Biophys Res Commun. 2007 Dec. 28; 364(4):985-989. PMID: 17971292.
25. Hall. A commotion in the blood: life, death, and the immune system. London: Little, Brown 1998; 1997.
26. Hasegawa et al. Activation of a consensus FNR-dependent promoter by DNR of *Pseudomonas aeruginosa* in response to nitrite. FEMS Microbiol Lett. 1998 Sep. 15; 166(2):213-217. PMID: 9770276.
27. Hoeren et al. Sequence and expression of the gene encoding the respiratory nitrous-oxide reductase from *Paracoccus denitrificans*. Eur J Biochem. 1993 Nov. 15; 218(1):49-57. PMID: 8243476.
28. Huang et al. A novel conditionally replicative adenovirus vector targeting telomerase-positive tumour cells. Clin Cancer Res 2004; 10(4): 1439-1445. PMID: 14977847.
29. Isabella et al. Deep sequencing-based analysis of the anaerobic stimulon in *Neisseria gonorrhoeae*. BMC Genomics. 2011 Jan. 20; 12:51. PMID: 21251255.
30. Jain et al. Can engineered bacteria help control cancer? Proc Natl Acad Sci USA. 2001 Dec. 18; 98(26):14748-50. PMID: 11752416.
31. Kinter et al. The common gamma-chain cytokines IL-2, IL-7, IL-15, and IL-21 induce the expression of programmed death-1 and its ligands. J Immunol. 2008 Nov. 15; 181(10):6738-6746. PMID: 18981091.
32. Liu et al. Tumor-targeting bacterial therapy: A potential treatment for oral cancer (Review). Oncol Lett. 2014 December; 8(6):2359-2366. PMID: 25364397.
33. Mead et al. Exocytosis of CTLA-4 is dependent on phospholipase D and ADP ribosylation factor-1 and stimulated during activation of regulatory T cells. J Immunol. 2005 Apr. 15; 174(8):4803-4811. PMID: 15814706.
34. Moore et al. Regulation of FNR dimerization by subunit charge repulsion. J Biol Chem. 2006 Nov. 3; 281(44): 33268-33275. PMID: 16959764.
35. Morrissey et al. Tumour targeting with systemically administered bacteria. Curr Gene Ther. 2010 February; 10(1):3-14.
36. Nauts et al. Coley toxins—the first century. Adv Exp Med Biol 1990; 267: 483-500. PMID: 2088067.
37. Nougayrede et al. *Escherichia coli* induces DNA double-strand breaks in eukaryotic cells. Science. 2006 Aug. 11; 313(5788):848-851. PMID: 16902142.
38. Nuno B, Chakrabarty A M, Fialho A M. Engineering of bacterial strains and their products for cancer therapy. Appl Microbiol Biotechnol. 2013 June; 97(12):5189-5199. PMID: 23644748.
39. Olier et al. Genotoxicity of *Escherichia coli* Nissle 1917 strain cannot be dissociated from its probiotic activity. Gut Microbes. 2012 November-December; 3(6):501-509. PMID: 22895085.

40. Patyar et al. Bacteria in cancer therapy: a novel experimental strategy. J Biomed Sci. 2010 Mar. 23; 17(1):21. PMID: 20331869.
41. Peggs et al. Blockade of CTLA-4 on both effector and regulatory T cell compartments contributes to the antitumor activity of anti-CTLA-4 antibodies. J Exp Med. 2009 Aug. 3; 206(8):1717-1725. PMID: 19581407.
42. Perkins et al. Regulation of CTLA-4 expression during T cell activation. J Immunol. 1996 Jun. 1; 156(11):4154-4159. PMID: 8666782.
43. Rajani et al. Harnessing the power of onco-immunotherapy with checkpoint inhibitors. Viruses. 2015 Nov. 13; 7(11):5889-5901. PMID: 26580645.
44. Ray et al. The effects of mutation of the anr gene on the aerobic respiratory chain of Pseudomonas aeruginosa. FEMS Microbiol Lett. 1997 Nov. 15; 156(2):227-232. PMID: 9513270.
45. Reister et al. Complete genome sequence of the Gram-negative probiotic Escherichia coli strain Nissle 1917. J Biotechnol. 2014 Oct. 10; 187:106-107. PMID: 25093936.
46. Rembacken et al. Non-pathogenic Escherichia coli versus mesalazine for the treatment of ulcerative colitis: a randomised trial. Lancet. 1999 Aug. 21; 354(9179):635-639. PMID: 10466665.
47. Remington's Pharmaceutical Sciences, 22$^{nd}$ ed. Mack Publishing Co. Easton, Pa. 48. Riley et al. Modulation of TCR-induced transcriptional profiles by ligation of CD28, ICOS, and CTLA-4 receptors. Proc Natl Acad Sci USA. 2002 Sep. 3; 99(18):11790-11795. PMID: 12195015.
49. Salmon et al. Global gene expression profiling in Escherichia coli K12. The effects of oxygen availability and FNR. J Biol Chem. 2003 Aug. 8; 278(32):29837-29855. PMID: 12754220.
50. Sat et al. The Escherichia coli mazEF suicide module mediates thymineless death. J Bacteriol. 2003 March; 185(6):1803-1807. PMID: 12618443.
51. Sawers. Identification and molecular characterization of a transcriptional regulator from Pseudomonas aeruginosa PAO1 exhibiting structural and functional similarity to the FNR protein of Escherichia coli. Mol Microbiol. 1991 June; 5(6):1469-1481. PMID: 1787797.
52. Schultz. Clinical use of E. coli Nissle 1917 in inflammatory bowel disease. Inflamm Bowel Dis. 2008 July; 14(7):1012-1018. PMID: 18240278.
53. Śledzińska et al. Negative immune checkpoints on T lymphocytes and their relevance to cancer immunotherapy. Mol Oncol. 2015 December; 9(10):1936-1965. PMID: 26578451.
54. Sonnenborn et al. The non-pathogenic Escherichia coli strain Nissle 1917—features of a versatile probiotic. Microbial Ecology in Health and Disease. 2009; 21:122-158.
55. Teicher. Physiologic mechanisms of therapeutic resistance. Blood flow and hypoxia. Hematol Oncol Clin North Am. 1995 April; 9(2):475-506. PMID: 7642474.
56. Theys et al. Repeated cycles of Clostridium-directed enzyme prodrug therapy result in sustained antitumour effects in vivo. Br J Cancer. 2006 Nov. 6; 95(9):1212-9. PMID: 17024128.
57. Trunk et al. Anaerobic adaptation in Pseudomonas aeruginosa: definition of the ANR and DNR regulons. Environ Microbiol. 2010 June; 12(6):1719-1733. PMID: 20553552.
58. Ukena et al. Probiotic Escherichia coli Nissle 1917 inhibits leaky gut by enhancing mucosal integrity. PLoS One. 2007 Dec. 12; 2(12):e1308. PMID: 18074031.
59. Unden et al. Alternative respiratory pathways of Escherichia coli: energetics and transcriptional regulation in response to electron acceptors. Biochim Biophys Acta. 1997 Jul. 4; 1320(3):217-234. PMID: 9230919.
60. Vaupel et al. Oxygenation status of human tumours: reappraisal using computerized pO2 histography. In: Vaupel P W, Ed. Tumour Oxygenation. Germany: Gustav Fischer Verlag, 1995; 219-232.
61. Wachsberger et al. Tumor response to ionizing radiation combined with antiangiogenesis or vascular targeting agents: exploring mechanisms of interaction. Clin Cancer Res. 2003 June; 9(6):1957-1971. PMID: 12796357.
62. Walunas et al. CTLA-4 can function as a negative regulator of T cell activation. Immunity. 1994 August; 1(5):405-413. PMID: 7882171.
63. Winteler et al. The homologous regulators ANR of Pseudomonas aeruginosa and FNR of Escherichia coli have overlapping but distinct specificities for anaerobically inducible promoters. Microbiology. 1996 March; 142(Pt 3):685-693. PMID: 8868444.
64. Wright et al. GeneGuard: A modular plasmid system designed for biosafety. ACS Synth Biol. 2015 Mar. 20; 4(3):307-316. PMID: 24847673.
65. Wu et al. Direct regulation of the natural competence regulator gene tfoX by cyclic AMP (cAMP) and cAMP receptor protein in Vibrios. Sci Rep. 2015 Oct. 7; 5:14921. PMID: 26442598.
66. Zhang et al. Escherichia coli Nissle 1917 targets and restrains mouse B16 melanoma and 4 T1 breast tumor through the expression of azurin protein. Appl Environ Microbiol. 2012 November; 78(21):7603-7610. PMID: 22923405.
67. Zimmermann et al. Anaerobic growth and cyanide synthesis of Pseudomonas aeruginosa depend on ANR, a regulatory gene homologous with FNR of Escherichia coli. Mol Microbiol. 1991 June; 5(6):1483-1490. PMID: 1787798.
68. Cancer Therapy Vol 6, 545-552, 2008 "Techniques for intratumoral chemotherapy of lung cancer by bronchoscopic drug delivery" Firuz Celikoglu, Seyhan I Celikoglu, Eugene P Goldberg
69. J Vasc Intery Radiol. 2010 October; 21(10):1533-8. Single-session percutaneous ethanol ablation of early-stage hepatocellular carcinoma with a multipronged injection needle: results of a pilot clinical study. Lencioni R, Crocetti L, Cioni D, Pina C D, Oliveri F, De Simone P, Brunetto M, Fi
70. Therap Adv Gastroenterol. 2008 September; 1(2): 103-109. Endoscopic Ultrasound-Guided Fine Needle Injection for Cancer Therapy: The Evolving Role of Therapeutic Endoscopic Ultrasound. Elizabeth C. Verna and Vasudha Dha
71. Mol Clin Oncol. 2013 March-April; 1(2): 231-234. Local drug delivery to a human pancreatic tumor via a newly designed multiple injectable needle. Koji Ohara, Masayuki Kohno, Tomohisa Horibe, and Koji Kawakami
72. Gastroenterol Res Pract. 2013; 2013: 207129. Therapeutic Endoscopic Ultrasonography: Intratumoral Injection for Pancreatic Adenocarcinoma. Lawrence A. Shirley, Laura K. Aguilar, Estuardo Aguilar-Cordova, Mark Bloomston, and Jon P. Walker
73. Lambin P, Theys J, Landuyt W, Rijken P, van der Kogel A, van der Schueren E, Hodgkiss R, Fowler J, Nuyts S, de Bruijn E, Van Mellaert L, Anne J. Colonisation of Clostridium in the body is restricted to hypoxic and necrotic areas of tumours. Anaerobe. 1998; 4:183-188.

74. Oncotarget. 2015 Mar. 20; 6(8): 5536-5546. *Clostridium novyi*-NT can cause regression of orthotopically implanted glioblastomas in rats. Verena Staedtke, Ren-Yuan Bai, Weiyun Sun, Judy Huang, Kathleen Kazuko Kibler, Betty M. Tyler, Gary L. Gallia, Kenneth Kinzler, Bert Vogelstein, Shibin Zhou, and Gregory J. Riggins
75. Cancer Immun. 2013; 13:5. Epub 2013 Jan. 22. CTLA-4 blockade in tumor models: an overview of preclinical and translational research. Joseph F. Grosso and Maria N. Jure-Kunkel
76. Gilson Baia, David Vasquez-Dunddel, Daniel Ciznadija, David Sidransky, Amanda Katz, Keren Paz. A humanized mouse model for translational assessment of targeted immune checkpoint blockade. [abstract]. In: Proceedings of the 106th Annual Meeting of the American Association for Cancer Research; 2015 Apr. 18-22; Philadelphia, Pa. Philadelphia (Pa.): AACR; Cancer Res 2015; 75(15 Suppl):Abstract nr 5031. doi:10.1158/1538-7445.AM2015-5031
77. Stritzker J, Weibel S, Hill P J, Oelschlaeger T A, Goebel W, Szalay A A. Tumor-specific colonization, tissue distribution, and gene induction by probiotic *Escherichia coli* Nissle 1917 in live mice. Int J Med Microbiol 2007; 297:51^62.
78. Pedersen A E, Buus S, Claesson MHTreatment of transplanted CT26 tumour with dendritic cell vaccine in combination with blockade of vascular endothelial growth factor receptor 2 and CTLA-4. Cancer Lett 235: 229-238
79. Curr Protoc Immunol. 2008 May; CHAPTER: Unit-15.21. Creation of "Humanized" Mice to Study Human Immunity. Todd Pearson, 1 Dale L. Greiner, 2 and Leonard D. Shultz
80. Heap et al., 2014. Oncotarget, Vol. 5, No. 7. Spores of *Clostridium* engineered for clinical efficacy and safety cause regression and cure of tumors in vivo.
81. Roberts et al., Sci Transl Med. 2014 Aug. 13; 6(249): 249ra111. Intratumoral injection of *Clostridium novyi*-NT spores induces antitumor responses
82. J Immunol. 2014 Jul. 15; 193(2):587-96. doi: 10.4049/jimmuno1.1302455. Epub 2014 Jun. 18.
Humanized mice as a model for aberrant responses in human T cell immunotherapy. Vudattu N K, Waldron-Lynch F, Truman L A, Deng S, Preston-Hurlburt P, Tones R, Raycroft M T, Mamula M J, Herold K C.

EXAMPLES

The following examples provide illustrative embodiments of the disclosure. One of ordinary skill in the art will recognize the numerous modifications and variations that may be performed without altering the spirit or scope of the disclosure. Such modifications and variations are encompassed within the scope of the disclosure. The Examples do not in any way limit the disclosure.

The disclosure provides herein a sequence having at least about 80%, at least about 85%, at least about 90%, at least about 95%, or at least about 99% homologous to the sequence any of the SEQ ID NOs described in the Examples, below.

Example 1. Anti-Cancer Molecules

Exemplary nucleic acid sequences for use in constructing single-chain anti-CTLA-4 antibodies are shown below in Table 69:

TABLE 69

| DESCRIPTION | SEQUENCE |
|---|---|
| $V_H$ (10D1) SEQ ID NO: 755 | CAGGTGCAGCTGGTGGAGTCTGGGGGAGGCGTGGTCCAGCCT GGGAGGTCCCTGAGACTCTCCTGTGCAGCCTCTGGATTCACCT TCAGTAGCTATACTATGCACTGGGTCCGCCAGGCTCCAGGCAA GGGGCTGGAGTGGGTGACATTTATATCATATGATGGAAACAA TAAATACTACGCAGACTCCGTGAAGGGCCGATTCACCATCTCC AGAGACAATTCCAAGAACACGCTGTATCTGCAAATGAACAGCC TGAGAGCTGAGGACACGGCTATATATTACTGTGCGAGGACCG GCTGGCTGGGGCCCTTTGACTACTGGGGCCAGGGAACCCTGG TCACCGTCTCCTCAG |
| $V_L$ (10D1) SEQ ID NO: 756 | GAAATTGTGTTGACGCAGTCTCCAGGCACCCTGTCTTTGTCTCC AGGGGAAAGAGCCACCCTCTCCTGCAGGGCCAGTCAGAGTGT TGGCAGCAGCTACTTAGCCTGGTACCAGCAGAAACCTGGCCA GGCTCCCAGGCTCCTCATCTATGGTGCATTCAGCAGGGCCACT GGCATCCCAGACAGGTTCAGTGGCAGTGG GTCTGGGACAGACTTCACTCTCACCATCAGCAGACTGGAGCCT GAAGATTTTGCAGTGTATTACTGTCAGCAGTATGGTAGCTCAC CGTGGACGTTCGGCCAAGGGACCAAGGTGGAAATCAAAC |
| $V_H$ (4B6) SEQ ID NO: 757 | CAGGTGCAGCTGGTGGAGTCTGGGGGAGGCGTGGTCCAGCCT GGGAGGTCCCTGAGACTCTCCTGTGCAGCCTCTGGATTCACCT TCAGTAGCTATACTATGCACTGGGTCCGCCAGGCTCCAGGCAA GGGGCTGGAGTGGGTGACATTTATATCATATGATGGAAGCAA TAAACACTACGCAGACTCCGTGAAGGGCCG ATTCACCGTCTCCAGAGACAATTCCAAGAACACGCTGTATCTG CAAATGAACAGCCTGAGAGCTGAGGACACGGCTATATATTACT GTGCGAGGACCGGCTGGCTGGGGCCCTTTGACTACTGGGGCC AGGGAACCCTGGTCACCGTCTCCTCAG |

TABLE 69-continued

| DESCRIPTION | SEQUENCE |
|---|---|
| $V_L$ (4B6)<br>SEQ ID NO: 758 | GAAATTGTGTTGACGCAGTCTCCAGGCACCCTGTCTTTGTCTCC<br>AGGGGAAAGAGCCACCCTCTCCTGCAGGGCCAGTCAGAGTGT<br>TAGCAGCAGCTTCTTAGCCTGGTACCAGCAGAAACCTGGCCAG<br>GCTCCCAGGCTCCTCATCTATGGTGCATCCAGCAGGGCCACTG<br>GCATCCCAGACAGGTTCAGTGGCAGTGG<br>GTCTGGGACAGACTTCACTCTCACCATCAGCAGACTGGAGCCT<br>GAAGATTTTGCAGTGTATTACTGTCAGCAGTATGGTAGCTCAC<br>CGTGGACGTTCGGCCAAGGGACCAAGGTGGAAATCAAAC |
| $V_H$ (1E2)<br>SEQ ID NO: 759 | CAGGTGCAGCTGGTGGAGTCTGGGGGAGGCGTGGTCCAGCCT<br>GGGAGGTCCCTGAGACTCTCCTGTGCAGCGTCTGGATTCACCT<br>TCAGTAGCTATGGCATGCACTGGGTCCGCCAGGCTCCAGGCA<br>AGGGGCTGGAGTGGGTGGCAGTTATATGGTATGATGGAAGTA<br>ATAAATACTATGCAGACTCCGTGAAGGGCCG<br>ATTCACCATCTCCAGAGACAATTCCAAGAACACGCTGTATCTGC<br>AAATGAACAGCCTGAGAGCCGAGGACACGGCTGTGTTTTACT<br>GTGCGAGAGCTCCCAATTATATTGGTGCTTTTGATGTCTGGGG<br>CCAAGGGACAATGGTCACCGTCTCTTCAG |
| $V_L$ (1E2)<br>SEQ ID NO: 760 | GACATCCAGATGACCCAGTCTCCATCCTCACTGTCTGCATCTGT<br>AGGAGACAGAGTCACCATCACTTGTCGGGCGAGTCAGGGTAT<br>TAGCAGCTGGTTAGCCTGGTATCAGCAGAAACCAGAGAAAGC<br>CCCTAAGTCCCTGATCTATGCTGCATCCAGTTTGCAAAGTGGG<br>GTCCCATCAAGGTTCAGCGGCAGTGGATC<br>TGGGACAGATTTCACTCTCACCATCAGCAGCCTGCAGCCTGAA<br>GATTTTGCAACTTATTACTGCCAACAGTATAATAGTTACCCTCC<br>GACGTTCGGCCAAGGGACCAAGGTGGAAATCAAAC |

In some embodiments, genetically engineered bacteria comprise a nucleic acid sequence that is at least about 80%, at least about 85%, at least about 90%, at least about 95%, or at least about 99% homologous to the DNA sequence of SEQ ID NO: 755, SEQ ID NO: 756, SEQ ID NO: 757, SEQ ID NO: 758, SEQ ID NO: 759, and/or SEQ ID NO: 760.

Exemplary heavy and light chain amino acid sequences for use in constructing single-chain anti-CTLA-4 antibodies are shown below in Table 70:

TABLE 70

| Amino Acid Sequence | 0123456789012345678901234567890123456789 |
|---|---|
| Heavy chain<br>(human monoclonal)<br>SEQ ID NO: 761 | QVQLVESGGGVVQPGRSLRLSCAASGFTFSSYGMHWVRQAPGK<br>GLEWVAVIWYDGSNKYYADSVKGRFTISRDNSKNTLYLQMNSLR<br>AEDTAVYYCARDPRGATLYYYYYGMDVWGQGTTVTVSSASTKG<br>PSVFPLAPCSRSTSESTAALGCLVKDYFPEPVTVSWNSGALTSGVH<br>TFPAVLQSSGLYSLSSVVTVPSSNFGTQTYTCNVDHKPSNTKVDK<br>TVERKCCVECPPCPAPPVAGPSVFLFPPKPKDTLMISRTPEVTCVV<br>VDVSHEDPEVQFNWYVDGVEVHNAKTKPREEQFNSTFRVVSVL<br>TVVHQDWLNGKEYKCKVSNKGLPAPIEKTISKTKGQPREPQVYTL<br>PPSREEMTKNQVSLTCLVKGFYPSDIAVEWESNGQPENNYKTTP<br>PMLDSDGSFFLYSKLTVDKSRWQQGNVFSCSVMHEALHNHYTQ<br>KSLSLSPGK |
| Light chain<br>(human monoclonal)<br>SEQ ID NO: 762 | DIQMTQSPSSLSASVGDRVTITCRASQSINSYLDWYQQKPGKAPK<br>LLIYAASSLQSGVPSRFSGSGSGTDFTLTISSLQPEDFATYYCQQYY<br>STPFTFGPGTKVEIKRTVAAPSVFIFPPSDEQLKSGTASVVCLLNNF<br>YPREAKVQWKVDNALQSGNSQESVTEQDSKDSTYSLSSTLTLSKA<br>DYEKHKVYACEVTHQG LSSPVTKSFNRGEC |
| Heavy chain<br>(human monoclonal)<br>SEQ ID NO: 763 | QVQLVESGGGVVQPGRSLRLSCAASGFTFSSYTMHWVRQAPGK<br>GLEWVTFISYDGNNKYYADSVKGRFTISRDNSKNTLYLQMNSLRA<br>EDTAIYYCARTGWLGPFDYWGQGTLVTVSSASTKGPSVFPLAPSS<br>KSTSGGTAALGCLVKDYFPEPVTVSWNSGALTSGVHTFPAVLQSS<br>GLYSLSSVVTVPSSSLGTQTYICNVNHKPSNTKVDKRVEPKSCDKT<br>HTCPPCPAPELLGGPSVFLFPPKPKDTLMISRTPEVTCVVVDVSHE<br>DPEVKFNWYVDGVEVHNAKTKPREEQYNSTYRVVSVLTVLHQD<br>WLNGKEYKCKVSNKALPAPIEKTISKAKGQPREPQVYTLPPSRDEL<br>TKNQVSLTCLVKGFYPSDIAVEWESNGQPENNYKTTPPVLD<br>SDGSFFLYSKLTVDKSRWQQGNVFSCSVMHEALHNHYTQKSLSL<br>SPGK |

TABLE 70-continued

| Amino Acid Sequence | 0123456789012345678901234567890123456789 |
|---|---|
| Light chain<br>(human monoclonal)<br>SEQ ID NO: 764 | EIVLTQSPGTLSLSPGERATLSCRASQSVGSSYLAWYQQKPGQAP<br>RLLIYGAFSRATGIPDRFSGSGSGTDFTLTISRLEPEDFAVYYCQQY<br>GSSPWTFGQGTKVEIKRTVAAPSVFIFPPSDEQLKSGTASVVCLLN<br>NFYPREAKVQWKVDNALQSGNSQESVTEQDSKDSTYSLSSTLTLS<br>KADYEKHKVYACEVTHQ GLSSPVTKSFNRGEC |

TABLE 71

Selected constructs with single chain antibodies for Flagellar Type III Secretion

| Description | Sequence |
|---|---|
| anti CTLA-4 scFv; Heavy Chain-linker-Light Chain Transcribed from the native FliC promoter and 5'UTR (untranslated region) with an optimized ribosome binding site SEQ ID NO: 765 | MQVQLVESGGGVVQPGRSLRLSCAASGFTFSSYTMHWVRQAPGKGLEWVTFISYDGNN<br>KYYADSVKGRFTISRDNSKNTLYLQMNSLRAEDTAIYYCARTGWLGPFDYWGQGTLVTVS<br>SGGGSGGGSGGGSGGGEIVLTQSPGTLSLSPGERATLSCRASQSVGSSYLAWYQQKPGQ<br>APRLLIYGAFSRATGIPDRFSGSGSGTDFTLTISRLEPEDFAVYYCQQYGSSPWTFGQGTKV<br>EIK |
| anti CTLA-4 scFv; Codon-optimized Heavy Chain-linker-Light Chain Transcribed from the native FliC promoter and 5'UTR (untranslated region) with an optimized ribosome binding site SEQ ID NO: 766 | agcgggaataaggggcagagaaaagagtatttcgtcgactaacaaaaaatggctgtttgtgaaaaaaattctaa<br>aggttgttttacgacagacgataacagggt*tgacggcgattgagccgacgggtggaaacccaaaacgtaatc*<br>*aac*AAATAAAAATGAGGAGGCAATTCTAatgcaagtgcaactggtagagtccggtgggggcgtggt<br>gcagccgggtcgcagcctgcgtctgtcgtgcgcggcgagtggttttacgttttcgagttatactatgcactgggtt<br>cgtcaagcgccgggcaaaggcctggaatgggttactttcatttcttacgatggtaataataaatattatgcggat<br>tctgtgaaaggtcgctttactatttcgcgcgataacagtaaaaacactctgtatctgcaaatgaattctctgcgtg<br>cagaggatactgctatctattactgcgcgcgtacgggctggttgggcccgtttgattattggggccaaggcacttt<br>ggttactgtgtcatcgggcgggggctctggcggtggttcaggtggtggcagtggtggtggcgagatcgtgttgac<br>tcaatctccgggtactctgtctctgtctccgggtgaacgcgcgaccctgtcttgccgcgcttctcagagtgttggtt<br>catcgtatctggcatggtatcaacagaaaccgggtcaagcgccgcgtctgctgatttacggtgcttttagtcgcgc<br>aaccgggattccggatcgattttctggttcaggttctggcactgactttactttgactattagtcgtctggaaccgg<br>aggacttcgcggtttattattgccaacagtatggttcttctccgtggaccmggtcaaggcactaaagttgaaat<br>taaataa*tcgccgtaacctgattaactgagactgacggcaacgccaaattgcctgatgcgctgcgcttatcag*<br>*gcctacaaggggaattgcaatttattgaatttgcacatttttgtaggccggataaggcgtttacgccgcatccg*<br>*gcaacatgaatggtaatttgccagcaacgtgcttccccgccaacggcggggtttttctg* |
| anti CTLA-4 scFv; Light Chain-linker-Heavy Chain Transcribed from the native FliC promoter and 5'UTR (untranslated region) with an optimized ribosome binding site SEQ ID NO: 767 | MEIVLTQSPGTLSLSPGERATLSCRASQSVGSSYLAWYQQKPGQAPRLLIYGAFSRATGIPD<br>RFSGSGSGTDFTLTISRLEPEDFAVYYCQQYGSSPWTFGQGTKVEIKGGGSGGGSGGGSG<br>GGQVQLVESGGGVVQPGRSLRLSCAASGFTFSSYTMHWVRQAPGKGLEWVTFISYDGN<br>NKYYADSVKGRFTISRDNSKNTLYLQMNSLRAEDTAIYYCARTGWLGPFDYWGQGTLVT<br>VSS |
| anti CTLA-4 scFv; Codon-optimized Light Chain-linker-Heavy Chain Transcribed from the native FliC promoter and 5'UTR (untranslated region) with an optimized ribosome binding site SEQ ID NO: 768 | agcgggaataaggggcagagaaaagagtatttcgtcgactaacaaaaaatggctgtttgtgaaaaaaattctaa<br>aggttgttttacgacagacgataacagggt*tgacggcgattgagccgacgggtggaaacccaaaacgtaatc*<br>*aac*AGATTATAAGGAGTTAAATAGAAAAatggagattgtactgacccagagccctggtacattgtct<br>ttgtcgcctggtgaacgcgcgactctgtcttgtcgtgcgtctcagtctgttggtagttcgtatctggcgtggtatca<br>acaaaaaccgggccaagctccgcgtctgctgatttacggtgcatttagccgcgcgactggcattccggaccgctt<br>ttctgggtctggctcaggtaccgattttactctgactatttcgcgtctggagccggaggatttcgcggtttattact<br>gccagcaatatggttctagtccgtggaccttcggccaaggtactaaagtggaaatcaaaggcgggggttcgggt<br>ggtggctctgggggtggctcgggcggtgggcaggtgcaactggttgagagtggtggcggcgttgttcaaccggg<br>ccgctctctgcgcctgtcgtgcgctgcttctggctttacctttagctcttatacgatgcactgggttcgccaagctcc<br>gggtaaaggtctggagtgggtgactttcatttcttacgatggtaacaacaaatattatgctgattctgttaaagg<br>ccgttttactatttctcgagacaatagcaaaaacactctgtacctgcagatgaattctctgcgcgctgaagacac<br>cgcgatttattattgtgcgcgcactggttggctgggtccgtttgattattggggtcagggcacgctggttactgtta<br>gctcgtga*tcgccgtaacctgattaactgagactgacggcaacgccaaattgcctgatgcgctgcgcttatca*<br>*ggcctacaaggggaattgcaatttattgaatttgcacatttttgtaggccggataaggcgtttacgccgcatcc*<br>*ggcaacatgaatggtaatttgccagcaacgtgcttccccgccaacggcggggtttttctg* |
| anti PD-1 scFv; Heavy Chain-linker-Light Chain Transcribed from the native FliC promoter and 5'UTR (untranslated region) with an optimized ribosome binding site SEQ ID NO: 769 | MQVQLVESGGGVVQPGRSLRLDCKASGITFSNSGMHWVRQAPGKGLEWVAVIWYDGS<br>KRYYADSVKGRFTISRDNSKNTLFLQMNSLRAEDTAVYYCATNDDYWGQGTLVTVSSGG<br>GSGGGSGGGSGGGEIVLTQSPATLSLSPGERATLSCRASQSVSSYLAWYQQKPGQAPRLLI<br>YDASNRATGIPARFSGSGSGTDFTLTISSLEPEDFAVYYCQQSSNWPRTFGQGTKVEIK |

TABLE 71-continued

Selected constructs with single chain antibodies for Flagellar Type III Secretion

| Description | Sequence |
|---|---|
| anti PD-1scFv; Codon-optimized Heavy Chain-linker-Light Chain Transcribed from the native FliC promoter and 5'UTR (untranslated region) with an optimized ribosome binding site SEQ ID NO: 770 | agcgggaataaggggcagagaaaagagtatttcgtcgactaacaaaaaatggctgtttgtgaaaaaaattctaa<br>aggttgttttacgacagacgataacagggttgacggcgattgagccgacgggtggaaacccaaaacgtaatc<br>aacCTCAAAGAATTATAGGAAAGGAGGAAGCGATAAGTatgcaggtgcaattggtggagtcgg<br>gtggcggcgtggtgcaaccgggtcgtagcctgcgcctggattgtaaagcgtcaggcatcacgtttagcaattctg<br>gcatgcactgggtgcgtcaagcgccgggcaaaggtctggagtgggttgcggtaatttggtacgatggttctaaa<br>cgctattacgcggatagtgtgaaaggtcgctttactatctctcgcgataattctaaaaacaccctgtttctgcaaa<br>tgaattcgttgcgtgcggaagatactgcggtatattattgtgctactaacgatgattattggggtcaaggcaccct<br>ggtgactgtttcgagcggcggtggtagcggcggcggctctggtggtggttctggtggcggtgagattgtgctgac<br>tcaaagcccggcgaccctgtctctgtcgccgggtgaacgcgctactctgagttgccgtgcgtcgcaaagcgtgtc<br>ttcttatctggcgtggtaccaacaaaaaccgggtcaagcgccgcgcctgctgatatatgatgctagtaatcgtgc<br>aacgggtattccggcacgcttttcaggttctggcagcggcaccgatttcactctgactatctcgtcactggagccg<br>gaagactttgcggtttattattgtcagcaatcttctaattggccgcgtacgtttggtcagggcactaaagttgaaa<br>tcaaataatcgccgtaacctgattaactgagactgacggcaacgccaaattgcctgatgcgctgcgcttatca<br>ggcctacaaggggaattgcaatttattgaatttgcacatttttgtaggccggataaggcgtttacgccgcatcc<br>ggcaacatgaatggtaatttgccagcaacgtgcttccccgccaacggcggggtttttctg |
| anti PD-1 scFv; Light Chain-linker-Heavy Chain Transcribed from the native FliC promoter and 5'UTR (untranslated region) with an optimized ribosome binding site SEQ ID NO: 771 | MEIVLTQSPATLSLSPGERATLSCRASQSVSSYLAWYQQKPGQAPRLLIYDASNRATGIPAR<br>FSGSGSGTDFTLTISSLEPEDFAVYYCQQSSNWPRTFGQGTKVEIKGGGSGGGSGGGSGG<br>GQVQLVESGGGVVQPGRSLRLDCKASGITFSNSGMHWVRQAPGKGLEWVAVIWYDGS<br>KRYYADSVKGRFTISRDNSKNTLFLQMNSLRAEDTAVYYCATNDDYWGQGTLVTVSS |
| anti PD-1 scFv; Codon-optimized Light Chain-linker-Heavy Chain Transcribed from the native FliC promoter and 5'UTR (untranslated region) with an optimized ribosome binding site SEQ ID NO: 772 | agcgggaataaggggcagagaaaagagtatttcgtcgactaacaaaaaatggctgtttgtgaaaaaaattctaa<br>aggttgttttacgacagacgataacagggttgacggcgattgagccgacgggtggaaacccaaaacgtaatc<br>aacATCACCAATTTGAGGAAAGGTAAATatggaaatcgttttaacgcagtcgccggcgactctgtctt<br>tgtcgcctggtgaacgtgctacgctgtcttgccgcgcgtcacagtctgtgtcgtcatatctggcttggtaccaaca<br>gaaaccgggccaagctccgcgcctgctgatttatgatgcgtctaatcgcgcgaccggcattccggcgcgtttttct<br>ggctccggctctggcaccgactttactctgactatttcgtctctggaaccggaagatttgcggtgtactattgcca<br>gcaatcttctaattggccgcgcacgtttggtcaaggtaccaaggttgagatcaaaggtggtggctcgggcggcg<br>gttcgggcggcggctcaggtggtggccaagttcagttggttgagtctggcgggggcgtagtacaaccgggtcgtt<br>ctttgcgtctggattgcaaagcgagcggtattacctttagcaattcaggtatgcactgggtgcgccaagcgccgg<br>gcaaaggcctggaatgggttgcggtgatttggtacgatggctcgaaacgttattatgctgacagcgttaaaggt<br>cgttttactattagccgtgataattccaaaaatacgctgtttctgcagatgaatagcctgcgtgctgaagacactg<br>cggtttattactgtgctactaatgatgattactggggccagggcaccctggtgactgtgagttcttaatcgccgta<br>acctgattaactgagactgacggcaacgccaaattgcctgatgcgctgcgcttatcaggcctacaaggggaa<br>ttgcaatttattgaatttgcacatttttgtaggccggataaggcgtttacgccgcatccggcaacatgaatggt<br>aatttgccagcaacgtgcttccccgccaacggcggggtttttctg |
| anti PDL-1 scFv; Heavy Chain-linker-Light Chain Transcribed from the native FliC promoter and 5'UTR (untranslated region) with an optimized ribosome binding site SEQ ID NO: 773 | MEVQLVESGGGLVQPGGSLRLSCAASGFTFSDSWIHWVRQAPGKGLEWVAWISPYGGS<br>TYYADSVKGRFTISADTSKNTAYLQMNSLRAEDTAVYYCARRHWPGGFDYWGQGTLVTV<br>SSGGGSGGGSGGGSGGGGDIQMTQSPSSLSASVGDRVTITCRASQDVSTAVAWYQQKPG<br>KAPKLLIYSASFLYSGVPSRFSGSGSGTDFTLTISSLQPEDFATYYCQQYLYHPATFGQGTKV<br>EIKR |
| anti PDL-1 scFv; Codon-optimized Heavy Chain-linker-Light Chain Transcribed from the native FliC promoter and 5'UTR (untranslated region) with an optimized ribosome binding site SEQ ID NO: 774 | agcgggaataaggggcagagaaaagagtatttcgtcgactaacaaaaaatggctgtttgtgaaaaaaattctaa<br>aggttgttttacgacagacgataacagggttgacggcgattgagccgacgggtggaaacccaaaacgtaatc<br>aacTACATAATTTTGGGGAGGGTACTCGatggaagttcagctggtggagagtggtggcggtctggtg<br>cagccgggcggctctctgcgtctgagctgtgcggcgtctggctttacgttttctgacagttggattcactgggtgcg<br>ccaagcaccgggcaaaggcctggagtgggtggcgtggatttctccgtatggcggtagtacttattatgctgattc<br>tgtgaaaggccgttttaccatttcggcggacacttcaaaaaataccgcgtatctgcaaatgaatagcctgcgcgc<br>tgaagacacggctgtttactactgtgctcgccgccactggccgggcggtttcgattattggggccaaggcactct<br>ggtgactgtgagctctggcggcgggtcgggtggcggttctggcggtggcagtggcggtggtgatattcaaatga<br>cccaatctccgtcgtctctgagcgcgtctgtgggcgatcgtgtaaccattacttgtcgtgcgtcgcaggatgtgtct<br>actgctgtggcgtggtatcagcaaaaaccgggtaaagctccgaaactgctgatttatagcgcttcttttctgtata<br>gtggtgttccgtcacgttttagcggttcaggctctggtactgatttcacactgactatttcttctctgcaaccggaa<br>gatttcgcgacttattattgtcagcagtacttgtaccacccggcaacttttggtcagggcactaaagttgaaatta<br>aacgttaatcgccgtaacctgattaactgagactgacggcaacgccaaattgcctgatgcgctgcgcttatca<br>ggcctacaaggggaattgcaatttattgaatttgcacatttttgtaggccggataaggcgtttacgccgcatcc<br>ggcaacatgaatggtaatttgccagcaacgtgcttccccgccaacggcggggtttttctg |

TABLE 71-continued

Selected constructs with single chain antibodies for Flagellar Type III Secretion

| Description | Sequence |
| --- | --- |
| anti PDL-1 scFv; Light Chain-linker-Heavy Chain Transcribed from the native FliC promoter and 5'UTR (untranslated region) with an optimized ribosome binding site SEQ ID NO: 775 | MDIQMTQSPSSLSASVGDRVTITCRASQDVSTAVAWYQQKPGKAPKLLIYSASFLYSGVPS RFSGSGSGTDFTLTISSLQPEDFATYYCQQYLYHPATFGQGTKVEIKRGGGSGGGSGGGSG GGEVQLVESGGGLVQPGGSLRLSCAASGFTFSDSWIHWVRQAPGKGLEWVAWISPYGG STYYADSVKGRFTISADTSKNTAYLQMNSLRAEDTAVYYCARRHWPGGFDYWGQGTLVT VSS |
| anti PDL-1 scFv; Codon-optimized Light Chain-linker-Heavy Chain Transcribed from the native FliC promoter and 5'UTR (untranslated region) with an optimized ribosome binding site SEQ ID NO: 776 | agcgggaataagqggcagagaaaagagtatttcgtcgactaacaaaaaatggctgtttgtgaaaaaaattctaa aggttgttttacgacagacgataacaggggt*tgacggcgattgagccgacgggtggaaacccaaaacgtaatc aac*TGGCAGACGCCTAAGGAGGAAGACCatggatattcagatgactcagagccctagctcactgtct gcgtcagttggcgatcgtgtgactattacctgtcgcgctagtcaggatgtgtctacggcggttgcgtggtatcaac agaaaccgggcaaagctccgaaactgttgatttattcagcgtctttcctgtattcgggtgtgccttctcgcttttcg ggctctggtagcggtactgattttacgctgactattagttcactgcaaccggaggactttgcgacttattattgcc aacaatacctgtatcacccggcgaccttttggtcaaggcactaaagtggaaattaaacgcggcggcggcagcgg tggcggctctggtggtgggtctggtggtggtgaggttcagctggttgagtctggtggtggtctggttcaacctggg ggcagcctgcgcctgtcgtgcgcggcgtctggttttacgttctcagattcttggattcactgggtacgtcaagctcc gggcaaaggtctggagtgggtggcgtggatttctccgtatggcggttcgacgtattacgcggactctgttaaagg gcgttttacgatctcagcggatacttctaaaaatactgcgtatctgcaaatgaattctctgcgagcggaggatac cgcggtgtattactgtgctcgccgccactggcctggtggttcgattattggggtcaaggtaccctggtgactgttt cgtcttaa*cgccgtaacctgattaactgagactgacggcaacgccaaattgcctgatgcgctgcgcttatca ggcctacaaggggaattgcaatttattgaatttgcacattttttgtaggccggataaggcgtttacgccgcatcc ggcaacatgaatggtaatttgccagcaacgtgcttccccgccaacggcggggtttttctg* |

Table 71 Key:
Polynucleotide Sequences:
Lowercase double underline: fliC Promoter;
Italics lowercase double underline: fliC 5'Untranslated Region;
UPPERCASE SINGLE UNDERLINE: Optimized Ribosome Binding Site;
Bold lowercase: Protein Coding Sequence;
Italics: Terminator Sequence.
Polypeptide Sequences:
UPPERCASE SINGLE UNDERLINE: Light Chain;
UPPERCASE DOUBLE UNDERLINE: Heavy Chain;
UPPERCASE BOLD: Linker sequence In some embodiments, genetically engineered bacteria comprise a nucleic acid sequence that is at least about 80%, at least about 85%, at least about 90%, at least about 95%, or at least about 99% homologous to the DNA sequence or comprises a DNA sequence that encodes a polypeptide that is at least about 80%, at least about 85%, at least about 90%, at least about 95%, or at least about 99% p homologous to SEQ ID NO: 765, SEQ ID NO: 766, SEQ ID NO: 767, SEQ ID NO: 768, SEQ ID NO: 769, SEQ ID NO: 770, SEQ ID NO: 771, SEQ ID NO: 772, SEQ ID NO: 773, SEQ ID NO: 774, SEQ ID NO: 775, and/or SEQ ID NO: 776.

TABLE 72

Selected constructs with single chain antibodies for Type V Auto-secreter (pic Protein) Secretion

| Description | Sequence |
| --- | --- |
| anti CTLA-4 scFv; Heavy Light Transcribed from the native ptet (tetracycline responsive) promoter and with an optimized ribosome binding site expressed as a fusion protein with the native Nissle auto-secreter E. coli_01635 (where passenger protein was replaced with Heavy-Linker-Light) SEQ ID NO: 777 | mnkvyslkycpvtgglivvselasrvikktcrrlthillagipavylyypqisqaqivrQVQLVESGGGVVQPG RSLRLSCAASGFTFSSYTMHWVRQAPGKGLEWVTFISYDGNNKYYADSVKGRFTISRDNS KNTLYLQMNSLRAEDTAIYYCARTGWLGPFDYWGQGTLVTVSSGGGSGGGSGGGSGG GEIVLTQSPGTLSLSPGERATLSCRASQSVGSSYLAWYQQKPGQAPRLLIYGAFSRATGIPD RFSGSGSGTDFTLTISRLEPEDFAVYYCQQYGSSPWTFGQGTKVEIKfkaeadkaaaakadsf mnaqyknfmteynnlnkrmqdlrdtngdaqawarimsgaqsadgqysdnythvqvqfdkkheldqydlft gvtmtytdssadshafsgktksvggglyasalfesgayidligkyihhdndytgnfaglgtkhynthswyagaet gyryhlteetfiepgaelvygaysgktfrwkdgdmdlsmknrdfspligrtgielgktfsgkdwsvtaragtswg fdllnngetvlrdasgekrikgekdsrmlfnvgmnagikdnmrfglefeksafgkynvdnavnanfrymf* |

TABLE 72-continued

Selected constructs with single chain antibodies for Type V Auto-secreter (pic Protein) Secretion

| Description | Sequence |
|---|---|
| anti CTLA-4 scFv; Codon-optimized Heavy-Linker-Light Transcribed from the native ptet (tetracycline responsive) promoter and with an optimized ribosome binding site expressed as a fusion protein with the native Nissle auto-secreter *E. coli*_01635 (where the original passenger protein was replaced with Heavy-Linker-Light) SEQ ID NO: 778 | <u>atctaatctagacatcattaattcctaattttttgttgacactctatcattgatagagttatttttaccactccctatcagt<br>gatagagaaaagtgaaTTAAATATCAACTAGAGGTCACCAA</u>atgaacaaagtatatagcctgaaat<br>attgcccagtaactggggtctgattgtagtcagtgaactggcatcccgcgtcatcaaaaaaacctgccgtcgtc<br>tgactcacatcctgctggcgggtattccggctgtgtatctgtactacccgcagatctcccaggcaggtatcgtccg<br>ccaggtacaattagttgagagcggcggcggtgtggttcaaccgggccgtagtctgcgattgtcttgtgctgcatct<br>ggttttactttcagttcttacacgatgcactgggttcgccaagctccgggcaaaggcctggagtgggttacccttta<br>tttcttacgatggcaataataagtattacgctgattctgtgaaaggtcgctttactattagccgagataactctaa<br>aaatactctgtatctgcaaatgaattctctgcgtgcggaagatactgcgatctattattgtgcgcgtactggttgg<br>ctgggcccgtttgattattggggccaaggcacgctggttactgttagttcgggcggcggttctggtggcggctctg<br>gtggtggctctggcggcggcgagattgtgctgactcaatctccgggcacgctgtcactgtctccgggtgaacgcg<br>cgacccctgtcttgtcgcgcgagtcaaagtgttggttcttcttatctggcttggtatcagcaaaagcctggtcaagc<br>gccgcgtctgttgatttatggcgcgttttcgcgcgcgactggcattccggaccgattttctggttctggttctggcac<br>tgatttcactctgaccatttcacgcctggaaccggaggattttgcggtgtactattgccaacaatatggctcatcg<br>ccgtggacgtttggccaaggtactaaagttgagattaaattcaaagcggaggctgacaaggccgctgcagcaa<br>aagctgactcctttatgaacgcgggttacaaaaacttcatgaccgaggtaaataatctcaataaacgtatgggt<br>gatctgcgcgacactaatggggatgcaggcgcatgggcacgcattatgtctggtgcaggttcggcggatgggt<br>gtattctgacaattacactcatgttcaggtgggcttcgataaaaaacatgagctggacggtgtggatctgttcac<br>tggcgtaaccatgacttatactgattcaagcgcagacagccacgcattttcaggtaaaacgaaatcagttggcg<br>gcggtctgtatgcgagcgcactgttcgagagcggcgcctacattgatctaattggcaagtatattccaccatgata<br>atgattacacagggaactttgcaggcctgggcaccaaacactataacacgcattcatgtacgctggcgcaga<br>aaccgctatagataccacctgaccgaggaaacctttatcgaaccgcaagcggaactggtttacggtgcggtca<br>gtggcaagacctttcgttggaaagatggtgatatggatctgtcaatgaaaaaccgcgacttcagcccttgatcg<br>gccgcaccggcattgagctgggcaaaaccttctctggcaaagattggtctgttaccgcgcgtgcgggcacttcgt<br>ggcaatttgatctgctaaacaacggtgagactgtactgcgtgatgcgagtggcgaaaaacgtattaaaggtga<br>aaaagatagtaagaatgctattcaacgtgggcatgaatgcgcagatcaaagataacatgcgttttgggtggagt<br>ttgaaaaatccgcgttcggtaaatataatgttgacaatgctgtgaacgcgaatttccgctacatgttttaa<u>ctcta<br>acggacttgagtgaggttgtaaagggagttggctcctcggtaccaaattccagaaaagaggcctcccgaaa<br>gggggggccttttttcgtttt</u> |
| anti CTLA-4 scFv; Light-Linker-Heavy Transcribed from the native ptet (tetracycline responsive) promoter and with an optimized ribosome binding site expressed as a fusion protein with the native Nissle auto-secreter *E. coli*_01635 (where the original passenger protein was replaced with Light-Linker-Heavy) SEQ ID NO: 779 | mnkvyslkycpvtgglivvselasrvikktcrrlthillagipavylyypqisqagivr<u>EIVLIQSPGTLSLSPGE<br>RATLSCRASQSVGSSYLAWYQQKPGQAPRLLIYGAFSRATGIPDRFSGSGSGTDFTLTISRL<br>EPEDFAVYYCQQYGSSPWTFGQGTKVEIKGGGSGGGSGGGSGGGQVQLVESGGGVVQ<br>PGRSLRLSCAASGFTFSSYTMHWVRQAPGKGLEWVTFISYDGNNKYYADSVKGRFTISRD<br>NSKNTLYLQMNSLRAEDTAIYYCARTGWLGPFDYWGQGTLVTVSS</u>fkaeadkaaaakadsf<br>mnagyknfmtevnnlnkrmqdlrdtnqdaqawarimsqagsadqqysdnythvqvqfdkkheldqydlft<br>qytmtytdssadshafsqktksvgqqlyasalfesqayidligkyihhdndytqnfaqlqtkhynthswyaqaet<br>qyryhlteetfiepqaelvygaysqktfrwkdgdmdlsmknrdfspligrtqielqktfsqkdwsvtaraqtswq<br>fdllnnqetvlrdasqekrikgekdsrmlfnvqmnaqikdnmrfqlefeksafqkynvdnavnanfrymf* |
| anti CTLA-4 scFv; Codon-optimized Light-Linker-Heavy Transcribed from the native ptet (tetracycline responsive) promoter and with an optimized ribosome binding site expressed as a fusion protein with the native Nissle auto-secreter *E. coli*_01635 (where the original passenger protein was replaced with Light-Linker-Heavy) SEQ ID NO: 780 | <u>atctaatctagacatcattaattcctaattttttgttgacactctatcattgatagagttatttttaccactccctatcagt<br>gatagagaaaaataaaTTAAATATCAACTAGAGGTCACCAA</u>atgaacaaagtatatagcctgaaat<br>attgcccagtaactggggtctgattgtagtcagtgaactggcatcccgcgtcatcaaaaaaacctgccgtcgtc<br>tgactcacatcctgctggcgggtattccggctgtgtatctgtactacccgcagatctcccaggcaggtatcgtccg<br>cgaaattgtactgacccagtcgcctggtaccctgtctctgtcgccgggtgaacgtgctaccctgtcttgtcgtgctt<br>cgcaatcggttggctcgtcttatctggcatggtatcagcaaaaccgggccaagcgcctcgtctgctgatttatgg<br>cgcgttttctcgtgctacgggcattcctgatcgttttcgcggctctggctctggctactgatttacgctgactatcag<br>ccgcttggaacctgaagattttgcggttattattgccaacaatatggctcttctccgtggacgtttggtcaaggc<br>actaaagttgaaattaaaggtggtggctcgggcggtggttctggtggtggtagtggtggtggtcaagtgcagttg<br>gttgaatcgggtggcggtgttgtgcagcgggccgttcgttgcgtctgtcttgcgcagcgagtggtttcaccttctc<br>ttcttatactatgcactgggtgcgtcaagcacctggcaaaggtctggagtgggtaactttttattttcatacgatggt<br>aataataaatattatgcagatctgtaaaggtcgctttacgatttctcgcgataattcaaaaaatacgctgtatc<br>tgcagatgaattcgctgcgcgctgaggatactgcgatctactattgtgcgcgtactggttggctgggtccgtttga<br>ttactgggccaaggtacgctggttacagtttcgtcgttcaaagcggaggctgacaaggccgctgcagcaaaag<br>ctgactcctttatgaacgcgggttacaaaaacttcatgaccgaggtaaataatctcaataaacgtatgggtgatc<br>tgcgcgacactaatggggatgcaggcgcatgggcacgcattatgtctggtgcaggttcggcggatggcgggtat<br>tctgacaattacactcatgttcaggtgggcttcgataaaaaacatgagctggacggtgtggatctgttcactggc<br>gtaaccatgacttatactgattcaagcgcagacagccacgcattttcaggtaaaacgaaatcagttggcggcgg<br>tctgtatgcgagcgcactgttcgagagcggcgcctacattgatctaattggcaagtatattccaccatgataatga<br>ttacacagggaactttgcaggcctgggcaccaaacactataacacgcattcatgtacgctggcgcagaaacc<br>ggctatagataccacctgaccgaggaaacctttatcgaaccgcaagcggaactggtttacggtgcggtcagtgg<br>caagacctttcgttggaaagatggtgatatggatctgtcaatgaaaaaccgcgacttcagcccttgatcggccg<br>caccggcattgagctgggcaaaaccttctctggcaaagattggtctgttaccgcgcgtgcgggcacttcgtggca<br>atttgatctgctaaacaacggtgagactgtactgcgtgatgcgagtggcgaaaaacgtattaaaggtgaaaaa |

TABLE 72-continued

Selected constructs with single chain antibodies for Type V Auto-secreter (pic Protein) Secretion

| Description | Sequence |
| --- | --- |
| | gatagtagaatgctattcaacgtgggcatgaatgcgcagatcaaagataacatgcgttttgggttggagtttga<br>aaaatccgcgttcggtaaatataatgttgacaatgctgtgaacgcgaatttccgctacatgttttaa*ctctaacg*<br>*gacttgagtgaggttgtaaagggagttggctcctcggtaccaaattccagaaaagaggcctcccgaaaggg*<br>*gggcctttttttcgtttt* |
| anti PD-1 scFv;<br>Heavy-Linker-<br>Light Transcribed<br>from the native ptet<br>(tetracycline<br>responsive)<br>promoter and with<br>an optimized<br>ribosome binding<br>site expressed as a<br>fusion protein with<br>the native Nissle<br>auto-secreter<br>*E. coli*_01635<br>(where<br>the original<br>passenger protein<br>was replaced with<br>Heavy-Linker-<br>Light)<br>SEQ ID NO: 781 | mnkvyslkycpvtqgllivvselasrvikktcrrlthillagipavylyypqisqagivrQVQLVESGGGVVQPG<br>RSLRLDCKASGITFSNSGMHWVRQAPGKGLEWVAVIWYDGSKRYYADSVKGRFTISRDN<br>SKNTLFLQMNSLRAEDTAVYYCATNDDYWGQGTLVTVSSGGGSGGGSGGGSGGGEIVL<br>TQSPATLSLSPGERATLSCRASQSVSSYLAWYQQKPGQAPRLLIYDASNRATGIPARFSGSG<br>SGTDFTLTISSLEPEDFAVYYCQQSSNWPRTFGQGTKVEIKfkaeadkaaaakadsfmnaqykn<br>fmtevnnlnkrmqdlrdtnqdaqawarimsqaqsadqqysdnythvqvqfdkkheldqvdlftqytmtytd<br>ssadshafsgktksvgqglyasalfesqayidligkyihhdndytqnfaqlgtkhynthswyaqaetqyryhlte<br>etfiepqaelvygaysqktfrwkdgdmdlsmknrdfspligrtqielgktfsgkdwsvtaragtswqfdllnnge<br>tvlrdasgekrikgekdsrmlfnvgmnaqikdnmrfqlefeksafgkynvdnavnanfrymf* |
| anti PD-1 scFv;<br>Codon-optimized<br>Heavy-Linker-<br>Light Transcribed<br>from the native ptet<br>(tetracycline<br>responsive)<br>promoter and with<br>an optimized<br>ribosome binding<br>site expressed as a<br>fusion protein with<br>the native Nissle<br>auto-secreter<br>*E. coli*_01635 (where<br>the original<br>passenger protein<br>was replaced with<br>Heavy-Linker-<br>Light)<br>SEQ ID NO: 782 | atctaatctagacatcattaattcctaattttttgttgacactctatcattgatagagttatttttaccactccctatca<br>gtgatagagaaaagtgaaTTAAATATCAACTAGAGGTCACCAAatgaacaaagtatatagcctga<br>aatattgcccagtaactgggggtctgattgtagtcagtgaactggcatcccgcgtcatcaaaaaaacctgccgtc<br>gtctgactcacatcctgctggcgggtattccggctgtgtatctgtactaccccgcagatctcccaggcaggtatcgt<br>ccgccaagtacaactggttgaatccggcggaggagtggtgcaaccgggccgcagtttgcgtctgtgattgtaaag<br>cttcaggcatcacttttttctaattctggtatgcactgggttcgccaagctccgggtaaaggtctggagtgggttgc<br>ggtgatctggtatgatggttctaaacgatatatgcggatagtgttaagggtcgttttactatttctcgtgataatt<br>ctaagaacaccttgttttctgcagatgaatagtctgcgcgctgaggatactgcggtatattattgtgcgactaatg<br>acgattattggggccaaggcacgctggttaccgtgagctctggtggtggttcgggtggtggttctggtggtggga<br>gcggcggtggcgagatcgttctgactcaaagccccggcgactctgagtctgagtccgggtgaacgtgcgactctg<br>agctgcgtgcgtctcagagtgtgtcgagttatctggcgtggtaccaacaaaaaccgggccaggcgccgcact<br>gctgatttatgatgcttctaatcgtgcgactggtattccggcgcgctttagcggttctggctcaggcactgacttca<br>ctctgactatttcttcgctggaaccggaagattttgcggtgtactattgtcaacaatcatctaattggcctcgtacg<br>ttcggtcaaggtacaaaagtggagataaaattcaaagcggaggctgacaaggccgctgcagcaaaagctgac<br>tcctttatgaacgcgggttacaaaaacttcatgaccgaggtaaataatctcaataaacgtatgggtgatctgcgc<br>gacactaatggggatgcagcgcatgggcacgcattatgtctggtgcaggttcggcggatggcgggtattctga<br>caattacactcatgttcaggtgggcttcgataaaaaacatgagctggacggtgtggatctgttcactggcgtaac<br>catgacttatactgattcaagcgcagacagccacgcattttcaggtaaaacgaaatcagttggcggcggtctgt<br>atgcgagcgcactgttcgagagcggcgcctacattgatctaattggcaagtatattccaccatgataatgattaca<br>cagggaactttgcaggcctgggcaccaaaacactataacacgcattcatggtacgctggcgcagaaaccggctat<br>agataccacctgaccgaggaaaccttatcgaaccgcaagcggaactggtttacggtgcggtcagtggcaaga<br>cctttcgttggaaagatggtgatatggatctgtcaatgaaaaaccgcgacttcagcccttgatcggccgcaccg<br>gcattgagctgggcaaaaccttctctggcaaagattggtctgttaccgcgcgtgcgggcacttcgtggcaatttg<br>atctgctaaacaacggtgagactgtactgcgtgatgcgagtggcgaaaaacgtattaaaggtgaaaaagatag<br>tagaatgctattcaacgtgggcatgaatgcgcagatcaaagataacatgcgttttgggttggagtttgaaaaat<br>ccgcgttcggtaaatataatgttgacaatgctgtgaacgcgaatttccgctacatgttttaa*ctctaacggacttg*<br>*agtgaggttgtaaagggagttggctcctcggtaccaaattccagaaaagaggcctcccgaaaggggggcc*<br>*ttttttcgtttt* |
| anti PD-1 scFv; Light-<br>Linker-Heavy<br>Transcribed from<br>the native ptet<br>(tetracycline<br>responsive)<br>promoter and with<br>an optimized<br>ribosome binding<br>site expressed as a<br>fusion protein with<br>the native Nissle<br>auto-secreter<br>*E. coli*_01635 | mnkvyslkycpvtqgllivvselasrvikktcrrlthillagipavylyypqisqagivrEIVLIQSPATLSLSPGE<br>RATLSCRASQSVSSYLAWYQQKPGQAPRLLIYDASNRATGIPARFSGSGSGTDFTLTISSLE<br>PEDFAVYYCQQSSNWPRTFGQGTKVEIKGGGSGGGSGGGSGGGQVQLVESGGGVVQP<br>GRSLRLDCKASGITFSNSGMHWVRQAPGKGLEWVAVIWYDGSKRYYADSVKGRFTISRD<br>NSKNTLFLQMNSLRAEDTAVYYCATNDDYWGQGTLVTVSSfkaeadkaaaakadsfmnaqyk<br>nfmtevnnlnkrmqdlrdtnqdaqawarimsqaqsadqqysdnythvqvqfdkkheldqvdlftqytmtyt<br>dssadshafsgktksvgqglyasalfesqayidligkyihhdndytqnfaqlgtkhynthswyaqaetqyryhlt<br>eetfiepqaelvygavsqktfrwkdgdmdlsmknrdfspligrtqielgktfsgkdwsvtaragtswqfdllnng<br>etvlrdasgekrikgekdsrmlfnvgmnaqikdnmrfqlefeksafgkynvdnavnanfrymf* |

TABLE 72-continued

Selected constructs with single chain antibodies for Type V Auto-secreter (pic Protein) Secretion

| Description | Sequence |
|---|---|
| (where the original passenger protein was replaced with Light-Linker-Heavy) SEQ ID NO: 783 | |
| anti PD-1 scFv; Codon-optimized Light-Linker-Heavy Transcribed from the native ptet (tetracycline responsive) promoter and with an optimized ribosome binding site expressed as a fusion protein with the native Nissle auto-secreter *E. coli*_01635 (where the original passenger protein was replaced with Light-Linker-Heavy) SEQ ID NO: 784 | <u>atctaatctagacatcattaattcctaattttttgttgacactctatcattgatagagttatttttaccactccctatcagt gatagagaaaaataaaTTAAATATCAACTAGAGGTCACCAA</u>atgaacaaagtatatagcctgaaat attgcccagtaactgggggtctgattgtagtcagtgaactggcatcccgcgtcatcaaaaaaacctgccgtcgtc tgactcacatcctgctggcgggtattccggctgtgtatctgtactacccgcagatctcccaggcaggtatcgtccg cgaaatcgtgctgactcagagtccggcgactctgtctctgagtccgggcgaacgcgcgactctgtcttgccgtgc gtctcaatctgtgtcttcatacttggcttggtaccaacaaaaaccgggccaggcgccgcgactgttgatttatgat gcgtcgaatcgcgcgactggcattccggcgcgcttttcgggtagcggttctggtactgattttacgctgactatctc ttctctggagcctgaagatttcgctgtttattactgccaacagtctagtaattggccgtacttttcggccagggc actaaggtggaaattaaaggtggcggctcgggcggcggctcggggtggtggttctggtggtggccaagtgcaact ggtggaaagtggcggcggggtggtgcaaccgggccgttctctgcgcctggattgtaaagcttcaggcattacttt tagcaactctggtatgcactgggtctcgccaagctccgggcaaaggcctggaatgggtggcggttatttggtacga tggctctaaacgttattacgctgacagtgttaaaggccgcttttaccatttctcgtgataattctaaaaataccctgt ttctgcaaatgaactcgctgcgcgcggaagatactgctgtttactattgtgcgactaatgatgattactgggtca aggtaccctggttaccgtgtcttcttcaaagcggaggctgacaaggccgctgcagcaaaagctgactccttat gaacgcgggttacaaaaacttcatgaccgaggtaaataatctcaataaacgtatgggtgatctgcgcgacact aatggggatgcaggcgcatgggcacgcattatgtctggtgcaggttcggcggatggcgggtattctgacaatta cactcatgttcaggtgggcttcgataaaaaacatgagctggacggtggatctgttcactggcgtaaccatgac ttatactgattcaagcgcagacagccacgcattttcaggtaaaacgaaatcagttggcggcggtctgtatgcga gcgcactgttcgagagcggcgcctacattgatcaattggcaagtatattccaccatgataatgattacacaggg aactttgcaggcctgggcaccaaaacactataacacgcattcatggtacgctggcgcagaaaccggctatagata ccacctgaccgaggaaaccttttatcgaaccgcaagcggaactggtttacggtgcggtcagtggcaagaccttc gttggaaagatggtgatatggatctgtcaatgaaaaaccgcgacttcagcccctttgatcggccgcaccggcatt gagctgggcaaaaacctctctggcaaagattggtctgttaccgcgcgtgcgggcacttcgtggcaatttgatctg ctaaacaacggtgagactgtactgcgtgatgcgagtggcgaaaaacgtattaaaggtgaaaaagatagtaga atgctattcaacgtgggcatgaatgcgcagatcaaagataacatgcgtttgggttggagtttgaaaaatccgc gttcggtaaatataatgttgacaatgctgtgaacgcgaatttccgctacatetttaa<u>ctctaacggacttgagt gaggttgtaaagggagttggctcctcggtaccaaattccagaaaagaggcctcccgaaggggggccttttt tcgtttt</u> |
| anti PDL-1 scFv; Heavy-Linker-Light Transcribed from the native ptet (tetracycline responsive) promoter and with an optimized ribosome binding site expressed as a fusion protein with the native Nissle auto-secreter *E. coli*_01635 (where the original passenger protein was replaced with Heavy-Linker-Light) SEQ ID NO: 785 | mnkvyslkycpvtgglivvselasrvikktcrrlthillaaipavylyypdisqagivrDIQMTQSPSSLSASVG DRVTITCRASQDVSTAVAWYQQKPGKAPKLLIYSASFLYSGVPSRFSGSGSGTDFTLTISSL QPEDFATYYCQQYLYHPATFGQGTKVEIKRGGGSGGGSGGGSGGGEVQLVESGGGLVQ PGGSLRLSCAASGFTFSDSWIHWVRQAPGKGLEWVAWISPYGGSTYYADSVKGRFTISAD TSKNTAYLQMNSLRAEDTAVYYCARRHWPGGFDYWGQGTLVTVSSfkaeadkaaaakadsf mnagyknfmtevnnlnkrmqdlrdtnqdagawarimsqagsadqgysdnythvqvqfdkkheldqvdlft qvtmtytdssadshafsqktksvqgqlyasalfesqayidligkyihhdndytqnfaqlgtkhynthswyaqaet qyryhlteetfiepqaelvygavsgktfrwkdgdmdlsmknrdfspliqrtgielqktfsqkdwsvtaragtswq fdllnnqetvlrdasgekrikqekdsrmlfnvqmnaqikdnmrfqlefeksafqkynvdnavnanfrymf* |
| anti PDL-1 scFv; Codon-optimized Heavy-Linker-Light Transcribed from the native ptet (tetracycline responsive) promoter and with an optimized ribosome binding site expressed as a fusion protein with the native Nissle auto-secreter *E. coli*_01635 (where the original | <u>atctaatctagacatcattaattcctaattttttgttgacactctatcattgatagagttatttttaccactccctatcagt gatagagaaaaataaaTTAAATATCAACTAGAGGTCACCAA</u>atgaacaaagtatatagcctgaaat attgcccagtaactgggggtctgattgtagtcagtgaactggcatcccgcgtcatcaaaaaaacctgccgtcgtc tgactcacatcctgctggcgggtattccggctgtgtatctgtactacccgcagatctcccaggcaggtatcgtccg cgaagtgcagctggtggagtcaggtggaggcttggtgcaacccgggcggttcactgcgtctgtcatgtgcggcgtc tgggtttactttagtgactcttggattcactgggtgcgccaggctccgggtaaaggcctggaatgggtagcttgg attagtccttacggtggctcgacctattatgctgattcagtgaaagggcgctttactattagcgctgatacttctaa aaatactgcatacctgcagatgaatagcctgcgcgctgaggatactgctgtgtattattgcgcgcgtcgccactg gccgggcggctttgattattggggccaaggtactctggttaccgtgtcagtgcggtggtagcggcggcggctc aggtggcggctcgggcggtggcgacattcagatgactcagtctccgtcttcttgtcggcgagcgtgggcgatcg tgttaccatcacgtgtcgcgcgcaagatgtgactgcggtggcgtggtatcaacaaaaaccgggtaaag ctccgaaactgctgatttatagtgcgtcttttttgtattctggtgttccgtctcgtttctctggctcaggtagcggtac tgattttacgctgactatttcttcactgcaaccggaagattttgctacgtattattgtcaacaatatctgtatcacc cggcgacgtttggtcagggtactaaggtggagataaaacgcttcaaagcggaggctgacaaggccgctgcagc aaaagctgactccttatgaacgcgggttacaaaaacttcatgaccgaggtaaataatctcaataaacgtatgg gtgatctgcgcgacactaatggggatgcaggcgcatgggcacgcattatgtctggtgcaggttcggcggatggc |

TABLE 72-continued

Selected constructs with single chain antibodies for Type V Auto-secreter (pic Protein) Secretion

| Description | Sequence |
|---|---|
| passenger protein was replaced with Heavy-Linker-Light) SEQ ID NO: 786 | gggtattctgacaattacactcatgttcaggtgggcttcgataaaaaacatgagctggacggtgtggatctgttc actggcgtaaccatgacttatactgattcaagcgcagacagccacgcatttcaggtaaaacgaaatcagttgg cggcggtctgtatgcgagcgcactgttcgagagcggcgcctacattgatctaattggcaagtatattcaccatga taatgattacacagggaactttgcaggcctgggcaccaaacactataacacgcattcatggtacgctggcgcag aaaccggctatagataccacctgaccgaggaaacctttatcgaaccgcaagcggaactggtttacggtgcggtc agtggcaagaccttctgttggaaagatggtgatatggatctgtcaatgaaaaaccgcgacttcagcccccttgatc ggccgcaccggcattgagctgggcaaaaaccttctctggcaaagattggtctgttaccgcgcgtgcgggcacttcg tggcaatttgatctgctaaacaacggtgagactgtactgcgtgatgcgagtggcgaaaaacgtattaaaggtga aaagatagtagaatgctattcaacgtgggcatgaatgcgcagatcaaagataacatgcgtttgggttggagt ttgaaaaatccgcgttcggtaaatataatgttgacaatgctgtgaacgcgaatttccgctacatgttttaa*ctcta* *acggacttgagtgaggttgtaaagggagttggctcctcggtaccaaattccagaaaagaggcctcccgaaa* *gggggggccttttttcgtttt* |
| anti PDL-1 scFv; Light-Linker-Heavy Transcribed from the native ptet (tetracycline responsive) promoter and with an optimized ribosome binding site expressed as a fusion protein with the native Nissle auto-secreter E. coli_01635 (where the original passenger protein was replaced with Light-Linker-Heavy) SEQ ID NO: 787 | mnkvyslkycpvtqqlivvselasrvikktcrrlthillaqipavylyypqisqaqivrEIVLIQSPATLSLSPGE RATLSCRASQSVSSYLAWYQQKPGQAPRLLIYDASNRATGIPARFSGSGSGTDFTLTISSLE PEDFAVYYCQQSSNWPRTFGQGTKVEIKGGGSGGGSGGGSGGGQVQLVESGGGVVQP GRSLRLDCKASGITFSNSGMHWVRQAPGKGLEWVAVIWYDGSKRYYADSVKGRFTISRD NSKNTLFLQMNSLRAEDTAVYYCATNDDYWGQGTLVTVSSfkaeadkaaaakadsfmnaqyk nfmtevnnlnkrmqdlrdtnqdaqawarimsqaqsadqqysdnythvqvqfdkheldqvdlftqvtmtyt dssadshafsqktksvqqqlyasalfesqayidliqkyihhdndytqnfaqlqtkhynthswyaqaetqyryhlt eetfiepqaelvyqaysqktfrwkdqdmdlsmknrdfspliqrtqielqktfsqkdwsvtaraqtswqfdllnnq etvlrdasqekrikqekdsrmlfnvqmnaqikdnmrfqlefeksafqkynvdnavnanfrymf* |
| anti PDL-1 scFv; Codon-optimized Light-Linker-Heavy Transcribed from the native ptet (tetracycline responsive) promoter and with an optimized ribosome binding site expressed as a fusion protein with the native Nissle auto-secreter E. coli_01635 (where the original passenger protein was replaced with Light-Linker-Heavy) SEQ ID NO: 788 | <u>atctaatctagacatcattaattcctaattttttgttgacactctatcattgatagagttatttaccactccctatcagt</u> <u>gatagagaaaaataaa</u>TTAAATATCAACTAGAGGTCACCAAatgaacaaagtatatagcctgaaat attgcccagtaactggggtctgattgtagtcagtgaactggcatcccgcgtcatcaaaaaaacctgccgtcgtc tgactcacatcctgctggcgggtattccggctgtgtatctgtactaccccgcagatctcccaggcaggtatcgtccg cgatattcaaatgactcaatctccgagctctctgagtgcgtctgtgggtgatcgtgtgactattacttgtcgtgcgt ctcaagatgtttcaactgcggttgcgtggtatcaacagaaacccgggcaaggcgcctaagctgctgatttattctg cttcgttcctgtacagcggtgtgccgtctctgttctctgtccctggttcgggtactgatttcactctgactatttcgag tctgcagccggaagattttgcgacttattattgtcaacaatatctgtatcaccctgccgactttggtcaaggcacg aaagttgaaattaaacgtggtggtggctctggtggtggcagcggtggtggtcgggtggcggtgaagttcaact ggttgagtcaggtggtggcctggtgcaaccgggcggctctctgcgcctgtcttgtgctgcgtcgggttttacgttct ctgatagctggattcactgggtacgccaggccacccgggcaaaggtctggaatgggtagcttggatttcacccatg gtggctctacttattacgcggatagcgtgaaaggtcgctttactattcgcggacactagcaaaaaatactgctta cctgcaaatgaattcgctgcgtgctgaggatactgcagtgtattactgtgcgacgtgacgcattggcctggcggcttt gattattggggtcaaggtactctggttactgttagcagcttcaaagcggaggctgacaaggccgctgcagcaaa agctgactcctttatgaacgcgggttacaaaaacttcatgaccgaggtaaataatctcaataaacgtatgggtg atctgcgcgacactaatggggatgcaggcgcatgggcacgcattatgtctggtgcaggttcggcggatggcggg tattctgacaattacactcatgttcaggtgggcttcgataaaaaacatgagctggacggtgtggatctgttcact ggcgtaaccatgacttatactgattcaagcgcagacagccacgcattttcaggtaaaacgaaatcagttggcg cggtctgtatgcgagcgcactgttcgagagcggcgcctacattgatctaattggcaagtatattcaccatgataa tgattacacagggaactttgcaggcctgggcaccaaacactataacacgcattcatggtacgctggcgcagaa accggctatagataccacctgaccgaggaaacctttatcgaaccgcaagcggaactggtttacggtgcggtcag tggcaagaccttctgttggaaagatggtgatatggatctgtcaatgaaaaaccgcgacttcagcccccttgatcgg ccgcaccggcattgagctgggcaaaaaccttctctggcaaagattggtctgttaccgcgcgtgcgggcacttcgtg gcaatttgatctgctaaacaacggtgagactgtactgcgtgatgcgagtggcgaaaaacgtattaaaggtgaa aagatagtagaatgctattcaacgtgggcatgaatgcgcagatcaaagataacatgcgtttgggttggagtt tgaaaaatccgcgttcggtaaatataatgttgacaatgctgtgaacgcgaatttccgctacatatttaa<i>ctcta</i> <i>acggacttgagtgaggttgtaaagggagttggctcctcggtaccaaattccagaaaagaggcctcccgaaa</i> <i>gggggggccttttttcgtttt</i> |

Table 72 Key:
Polynucleotide Sequences:
Lowercase double underline: Tetracycline-responsive promoter (Ptet);
UPPERCASE SINGLE UNDERLINE: Optimized Ribosome Binding Site;
Bold lowercase: Protein Coding Sequence;
Italics: Terminator Sequence TABLE 72-continued Selected constructs with single chain antibodies for Type V Auto-secreter (pic Protein) Secretion

| Description | Sequence |
| --- | --- |

Polypeptide Sequences:
Lowercase single underline: N-terminal Secretion Tag;
Lowercase double underline: C-terminal Secretion Tag;
UPPERCASE SINGLE UNDERLINE: Light Chain;
UPPERCASE DOUBLE UNDERLINE: Heavy Chain;
UPPERCASE BOLD: Linker sequence In some embodiments, genetically engineered bacteria comprise a nucleic acid sequence that is at least about 80%, at least about 85%, at least about 90%, at least about 95%, or at least about 99% homologous to the DNA sequence or comprises a DNA sequence that encodes a polypeptide that is at least about 80%, at least about 85%, at least about 90%, at least about 95%, or at least about 99% homologous to SEQ ID NO: 777, SEQ ID NO: 778, SEQ ID NO: 779, SEQ ID NO: 780, SEQ ID NO: 781, SEQ ID NO: 782, SEQ ID NO: 783, SEQ ID NO: 784, SEQ ID NO: 785, SEQ ID NO: 786, SEQ ID NO: 787, and/or SEQ ID NO: 788.

TABLE 73

Selected constructs with single chain antibodies for Type I Hemolysin Secretion

| Description | Sequence |
| --- | --- |
| anti CTLA-4 scFv; Heavy Chain-linker-Light Chain transcribed from the native ptet (tetracycline responsive) promoter and with an optimized ribosome binding site expressed as fusion protein with the 53 amino acids of the C termini of alpha-hemolysin (hlyA) of E. coli CFT073. SEQ ID NO: 789 | MQVQLVESGGGVVQPGRSLRLSCAASGFTFSSYTMHWVRQAPGKGLEWVTFISYDGN NKYYADSVKGRFTISRDNSKNTLYLQMNSLRAEDTAIYYCARTGWLGPFDYWGQGTLVT VSSGGGSGGGSGGGSGGGEIVLTQSPGTLSLSPGERATLSCRASQSVGSSYLAWYQQKP GQAPRLLIYGAFSRATGIPDRFSGSGSGTDFTLTISRLEPEDFAVYYCQQYGSSPWTFGQG TKVEIKlnplineiskiisaaqnfdvkeeraaasllqlsqnasdfsyqrnsitltasa* |
| anti CTLA-4 scFv; Codon-optimized Heavy Chain-linker-Light Chain transcribed from the native ptet (tetracycline responsive) promoter and with an optimized ribosome binding site expressed as fusion protein with the 53 amino acids of the C termini of alpha-hemolysin (hlyA) of E. coli CFT073.) SEQ ID NO: 790 | gaattcgttaagacccactttcacattttaagttgttttttctaatccgcatatgatcaattcaaggccgaataagaa ggctggctctacaccttggtgatcaaataattcgatagcttgtcgtaataatggcggcatactatcagtagtaggt gtttcccttctttcttagcgacttgatgctcttgatcttccaatacgcaacctaaagtaaaatgccccacagcgct gagtgcatataatgcattctctagtgaaaaaccttgttggcataaaaaggctaattgattttcgagagtttcatac tgttttttctgtaggccgtgtacctaaatgtacttttgctccatcgccgatgacttagtaaagcacatctaaaacttta gcgttattacgtaaaaaatcttgccagctttccccttctaaaggqcaaaagtgagtatgqtgctatctaacatct caatggctaaggcgtcgagcaaagcccgcttattttttacatgccaatacaatgtaggctgctctacacctagctt ctgggcgagtttacgggttgttaaaccttcgattccgacctcattaagcagctctaatgcgctgttaatcacttac tttatctaatctagacatcattaattcctaatttttgttgacactctatcatttatagagttaatttaccactccctat cagtgatagaqaaaagtgaaTACGATTTAATTCGGAGGTTTTTTGatgcaggtacaattagttgag agcggcggcggtgtggttcaaccgggccgtagtctgcgattgtcttgtgctgcatctggttttactttcagttctt acacgatgcactggggttcgccaagctccgggcaaaggcctggagtgggttacctttatttcttacgatggcaat aataagtattacgctgattctgtgaaaggtcgctttactattagccgagataactctaaaaatactctgtatctg caaatgaattctctgcgtgcggaagatactgcgatctattattgtgcgcgtactggttggctgggcccgtttgat tattggggccaaggcacgctggttactgttagttcgggcggcggttctggtggcggctctggtggtggctctggc ggcggcgagattgtgctgactcaatctccgggcacgctgtcactgtctccgggtgaacgcgcgaccctgtcttgt cgcgcgagtcaaagtgttggttcttcttatctggcttggtatcagcaaaagcctggtcaagcgccgcgtctgttg atttatggcgcgttttcgcgcgcgactggcattccggaccgatttttgttctggttctggcactgatttcactct gaccatttcacgcctggaaccggaggattttgcggtgtactattgccaacaatatggctcatcgccgtggacgt ttggccaaggtactaaagttgagattaaacttaatccattaattaatgaaatcagcaaaatcatttcagctgca ggtaatttttgatgttaaagaggaaagagctgcagcttctttattgcagttgtccggtaatgccagtgattttca tatggacggaactcaataactttgacagcatcagcataatttattaatttaaataatagcaatcttactgggctg tgccacataagattgctattttttttggagtcataatggattcttgtcataaaattgattatgggttatacgcctgg agatttagcccaataccataacgtctctgttaaccccggaagaaattaaacatagatttgacacagacgggac tggtctgggattaacgtcatggttgcttgctgcgaaatcttagaactaaaggtaaaacaggtaaaaaaaaca attgaccgattaaactttatttctttgccgcattagtctgqaqaqaqqatqqacqtcattttattctgactaaa gtcagtaaagaagcaaacagatatcttattttttgatctggagcaacgaaatccccgtgttctcgaacagtctga gtttgaggcgttataccaggggcatattattcttattgcttcccgttctctgttaccgggaaactggcaaaattt gactttacctggtttatccctgccattataaaatacagaaaaatatttattgaaaccccttgttgtatctgttttttt acaattatttgcattaataaccccctttttttttcaggtggttatgqacaaagtattagtacacaggggtttttca acccttaatgttattactgtcgcattatctgttgtggtggtgtttgagattatactcagcggtttaagaacttaca ttttgcacatagtacaagtcggattgatgttgagtgggtgccaaactcttccggcatttactggcgctaccga tctcttattttgagagtcgtcgtgttggtgatactgttgccagggtaagagaattagaccagatccgtaattttcta |

TABLE 73-continued

Selected constructs with single chain antibodies for Type I Hemolysin Secretion

| Description | Sequence |
|---|---|
| | gacaggacaggcattaacatctgttctggacttattattttcattcatatttttgcggtaatgtggtattacagc<br>ccaaagcttactctggtgatcttattttcgctgccctgtttatgctgcatggtctgtttttattagcccatttttgcga<br>cgtcgccttgatgataagttttcacggaatgcggataatcaatcttcctggtggaatcagtcacggcgattaa<br>cactataaaagctatggcagtctcacctcagatgacgaacatatgggacaaacaattggcaggatatgttgct<br>gcaggctttaaagtgacagtattagccaccattggtcaacaaggaatacagttaatacaaaagactgttatga<br>tcatcaacctgtggttgggagcacacctggttatttccggggatttaagtattggtcagttaattgcttttaatat<br>gcttgctggtcagattgttgcaccggttattcgccttgcacaaatctggcaggatttccagcaggttggtatatc<br>agttacccgccttggtgatgtgcttaactctccaactgaaagttatcatgggaaactggcattaccggaaatta<br>atggtaatatcacttttcgtaatatccggtttcgctataagcctgactctccggttattttagataataatcaatctc<br>agtattaagcaggggggaggttattggtattgtcggacgttctggttcaggaaaaagcacattaactaaatta<br>ttcaacgtttttatattcctgaaaatggccaggtcttaattgatggacatgatcttgcgttggccgatcctaactg<br>gttacgtcgtcaggtgggggttgtgttgcaggacaatgtgctgcttaatcgcagtattattgataatatctcact<br>ggctaatcctggtatgtccgtcgaaaaagttatttatgcagcgaaattagcaggcgctcatgattttatttctga<br>attgcgtgaggggtataacaccattgtcggggaacaggggggcaggattatccggaggtcaacgtcaacgcat<br>cgcaattgcaagggcgctggtgaacaaccctaaaatacttattttttgatgaagcaaccagtgctctggattatg<br>agtcggagcatatcatcatgcgcaatatgcacaaaatatgtaagggcagaacggttataatcattgctcatcg<br>tctgtctacagtaaaaaatgcagaccgcattattgtcatggaaaaaggaaaattgttgaacagggtaaaca<br>taaggaactgcttctgaaccggaaagtttatacagttacttatatcagttacagtcagactaacagaaagaa<br>cagaagaatatgaaaacatggttaatgggttcagcgagttcctgttgcgctataaacttgtctggagtgaaa<br>catggaaaatccggaagcaattagatactccggtacgtgaaaaggacgaaaatgaattcttacccgctcatct<br>ggaattaattgaaacgccggtatccagacgcggcgctctggttgcttattttattatgcgggtttctggttattgct<br>gtcattttatctgttttaggtcaggtggaaattgttgccactgcaaatgggaaattaacactaagtgggcgcag<br>caaagaaattaaacctattgaaaactcaatagttaaagaaattatcgtaaaagaaggagagtcagtccgga<br>aaggggatgtgttattaaagcttacagcactgggagctgaagctgatacgttaaaaacacagtcatcactgtt<br>acagaccaggctggaacaaactcggtatcaaattctgagcaggtcaattgaattaaataaactacctgaact<br>gaagcttcctgatgagccttatttttcagaatgtatctgaagaggaagtactgcgtttaacttctttgataaaaga<br>acagttttccacatggccaaatcagaagtatcaaaaagaactgaatctggataagaaaagagcagagcgat<br>taacaatacttgcccgtataaaccgttatgaaaatttatcgagagttgaaaaaagccgtctggatgatttcag<br>gagtttattgcataaacaggcaattgcaaaacatgctgtacttgagcaggagaataaatatgtcgaggcagc<br>aaatgaattacggcgttataaatcgcaactggagcaaattgagagtgagatattgtctgcaaaagaagaata<br>tcagcttgtcacgcagcttttttaaaaatgaaattttagacaagctaagacaaacaacagacaacattgagtta<br>ttaactctggagttagagaaaaatgaagagcgtcaacagcgcttcagtaatcaggggccctgtttcgggaaaa<br>gttcagcaactgaaggttcatactgaaggtgggggttgttacaacagcggaaacactgatggtcatcgttccgg<br>aagatgacacgctggaggttactgctctggtacaaaatgaagatattggtttttattaacgtcgggcagaatgc<br>catcattaaagtgggaggcctttccttacacccgatatggttatctggtgggtaaggtgaaaaatataaattttag<br>atgcaatgaagaccagaaactgggactcgtttttaatgtcattgtttctgttgaagagaatgatttgtcaacc<br>gggaataagcacattccattaagctcgggtatggctgtcactgcagaaataaagactggaatgcgaagcgta<br>atcagctatcttcttagtcctctggaagagtctgtaacagaaagtttacatgagcgttaagtctcagagccgcg<br>gtatccggctcatatcttctcctg |
| anti CTLA-4 scFv;<br>Light Chain-linker-<br>Heavy Chain<br>transcribed from the<br>native ptet<br>(tetracycline<br>responsive)<br>promoter and with<br>an optimized<br>ribosome binding site<br>expressed as fusion<br>protein with the 53<br>amino acids of the C<br>termini of alpha-<br>hemolysin (hlyA) of<br>E. coli CFT073.<br>SEQ ID NO: 791 | MEIVLTQSPGTLSLSPGERATLSCRASQSVGSSYLAWYQQKPGQAPRLLIYGAFSRATGIP<br>DRFSGSGSGTDFTLTISRLEPEDFAVYYCQQYGSSPWTFGQGTKVEIKGGGSGGGSGGG<br>SGGGQVQLVESGGGVVQPGRSLRLSCAASGFTFSSYTMHWVRQAPGKGLEWVTFISYD<br>GNNKYYADSVKGRFTISRDNSKNTLYLQMNSLRAEDTAIYYCARTGWLGPFDYWGQGT<br>LVTVSSlnplineiskiisaagnfdvkeeraaasllqlsqnasdfsygrnsitltasa* |
| anti CTLA-4 scFv;<br>Codon-optimized<br>Light Chain-linker-<br>Heavy Chain<br>transcribed from the<br>native ptet<br>(tetracycline<br>responsive)<br>promoter and with<br>an optimized<br>ribosome binding site<br>expressed as fusion<br>protein with the 53<br>amino acids of the C<br>termini of alpha-<br>hemolysin (hlyA) of<br>E. coli CFT073.<br>SEQ ID NO: 792 | gaattcgttaagacccactttcacatttaagttgttttctaatccgcatatgatcaattcaaggccgaataagaa<br>ggctggctctacacccttggtgatcaaataattcgatagcttgtcgtaataatggcggcatactatcagtagt<br>gtttcccttcttctttagcgacttgatgctcttgatcttccaatacgcaacctaaagtaaaatgcccacagcgct<br>gagtgcatataatgcattctctagtgaaaaaccttgttggcataaaaagctaattgattttcgagagtttcatac<br>tgtttttctgtaggccgtgctacctaaatgtactttttgctccatccgcgatgacttagtaaagcacatctaaaactttta<br>gcgttattacgtaaaaaatcttgccagctttcccccttctcaaagggcaaaagtgagtatggtgcctatctaacatct<br>caatggctaaggcgtcgagcaaagcccgctctattttttacatgccaatacaatgtaggctgctctacacctagctt<br>ctgggcgagtttacgggttgttaaaccttcgattccgacctcattaagcagctctaatgcgctgttaatcactttta<br>tttatctaatctagacatcattaattcctaatttttgttgacactctatcatttatagaagttaatttaccactccctat<br>cagtgatagagaaaagtgaaTCACAACGCTGAGAGAGAGAGAAATatgaaattgtactgaccca<br>gtcgcctggtaccctgtctctgtcgccgggtgaacgtgcaccctgtcttgtcgtgcttcgcaatcggttggctcg<br>tcttatctggcatggtatcagcaaaaacgggccaagcgcctcgtctgctgatttatggcgcgtttctcgtgct<br>acgggcattcctgatcgtttttcgggctctggctctggtactgatttttacgctgactatcagccgcttggaacctg<br>aagattttcgggttttattattgccaacaatatggctcttctccgtggacgtttggtcaaggcactaaagttgaaa<br>ttaaaggtggtggctcgggcgtggtctggtggtggtggtggtggtcaagtgcagttggttgaatcgggt<br>ggcggtgttgtgcagccgggccgttcgttgcgtctgtcttgcgcagcgagtggtttcaccttctcttcttatactat<br>gcactgggtgcgtcaagcacctggcaaaggtctggagtgggtaacttttatttcatacgatggtaataataaat<br>attatgcgagattctgtttaaaggtcgctttacgatttctcgcgataattcaaaaaaatacgctgtatctgcagatga |

TABLE 73-continued

Selected constructs with single chain antibodies for Type I Hemolysin Secretion

| Description | Sequence |
|---|---|
| | attcgctgcgcgctgaggatactgcgatctactattgtgcgcgtactggttggctgggtccgtttgattactggg |
| | gccaaggtacgctggttacagtttcgtcgcttaatccattaattaatgaaatcagcaaaatcatttcagctgca |
| | ggtaattttgatgttaaagaggaaagagctgcagcttctttattgcagttgtccggtaatgccagtgattttca |
| | tatggacggaactcaataacttttgacagcatcagcataatttattaatttaaataatagcaatcttactgggctg |
| | tgccacataagattgctattttttttggagtcata<u>atagatTcttatcataaaattgattatagattatacaccctag</u> |
| | <u>agattttaacccaataccataacatctctattaacccagaagaaattaaacatagatttgacacagacgagac</u> |
| | <u>tggtctgggattaacgtcatgattacttgctgcgaaatctttagaactaaaggtaaaacaggtaaaaaaaaca</u> |
| | <u>attgaccgattaaactttatttctttgcccgcattagtctggagagaggatggacgtcattttattctgactaaa</u> |
| | <u>gtcagtaaagaagcaaacagatatcttattttgatctggagcaacgaaatcccgtgttctcgaacagtctga</u> |
| | <u>gtttgaggcgttatatcaggggcatattattcttattgcttcccgttcttctgttaccgggaaactggcaaaattt</u> |
| | <u>gactttacctgatttatccctaccattataaaatacagaaaaatatttattgaaacccttattatatctatttttt</u> |
| | <u>acaattatttacattaataacccccttttttttcagatgattatagacaaaatattagtacacagaggattttca</u> |
| | <u>acccttaatgttattactgtcgcattatctgttgtggtgtgttgagattatactcagcggttaagaacttaca</u> |
| | <u>ttttgcacatagtacaagtcggattgatgttgagtgggtgccaaactcttccggcatttactggcgctaccga</u> |
| | <u>tctcttattttgagagtcgtcgtgttggtgatactgttgccagggtaagagaattagaccagatccgtaatttct</u> |
| | <u>gacaggacagacattaacatctattctagacttattattttcattcatattttttgcggtaatgtggtattacagc</u> |
| | <u>ccaaagcttactctggtgatctattttcgctgccctattatactgcatggtctgtttttattagcccattttgcga</u> |
| | <u>cgtcgccttgatgataaattttcacggaatacggataatcaatctttcctggtggaatcagtcacggcgattaa</u> |
| | <u>cactataaaagctatggcagtctcacctcagatgacgaacatatgggacaaacaattggcaggatatgttgct</u> |
| | <u>gcaggctttaaagtgacagtattagccaccattggtcaacaaggaatacagttaatacaaaagactgttatga</u> |
| | <u>tcatcaacctgtggttgggagcacactggttatttccgggagttaagtattggtcagttaattgcttttaatat</u> |
| | <u>gcttgctggtcagattgttgcaccggttattcgccttgcacaaatctggcaggatttccagcaggttggtatatc</u> |
| | <u>agttacccgccttggtgatgtgcttaactctccaactgaaagttatcatgggaaactggcattaccggaaatta</u> |
| | <u>atggtaatatcacttttcgtaatatccggtttcgctataagcctgactctccggttattttagataatatcaatctc</u> |
| | <u>agtattaagcaggggggaggttattggtattgtcggacgttctggttcaggaaaaagcacattaactaaattaa</u> |
| | <u>ttcaacgttttatattcctgaaaatggccaggtcttaattgatggacatgatcttgcgttggccgatcctaactg</u> |
| | <u>gttacgtcgtcaggtgggggttgtgttgcaggacaatgtgctgcttaatcgcagtattattgataatatctcact</u> |
| | <u>ggctaatcctggtatgtccgtcgaaaaagtatttatgcagcgaaattagcaggcgctcatgattttatttctga</u> |
| | <u>attgcgtgaggggtataacaccattgtcggggaacaggggggcaggattatccggaggtcaacgtcaacgcat</u> |
| | <u>cgcaattgcaagggcgctggtgaacaaccctaaaatacttattttttgatgaagcaaccagtgctctggattatg</u> |
| | <u>agtcggagcatatcatcatgcgcaatatgcacaaaatatgtaagggcagaacggttataatcattgctcatcg</u> |
| | <u>tctgtctacagtaaaaaatgcagaccgcattattgtcatggaaaaagggaaattgttgaacagggtaaaca</u> |
| | <u>taaggaactgctttctgaaccggaaagtttatacagttacttatatcagttacagtcagactaacagaaagaa</u> |
| | cagaaga<u>atatgaaaacatggttaatgggttcagcgagttcctgttgcgctataaacttgtctggagtgaaa</u> |
| | <u>catggaaatccggaagcaattagatactccggtacgtgaaaaggacgaaaatgaattcttacccgctcatct</u> |
| | <u>ggaattaattgaaacgccggtatccagacggccgcgtctggttgcttattttattatgggtgtttctggttattgct</u> |
| | <u>gtcatttatctgttttaggtcaggtggaaattgttgccactgcaaatgggaaattaacactaagtgggcgcag</u> |
| | <u>caaagaattaaacctattgaaaactcaatagttaaagaaattatcgtaaaagaaggaagcagtcagtccgga</u> |
| | <u>aagggatgtgttattaaagcttacagcactgggagctgaagctgatacgttaaaaaacacagtcatcactgtt</u> |
| | <u>acagaccaggctggaacaaactccggtatcaaattctgagcaggtcaattgaattaaataaactacctgaact</u> |
| | <u>gaagcttcctgatgagcctttattttcagaatgtatctgaagaggaagtactgcgtttaacttctttgataaaga</u> |
| | <u>acagttttccacatggcaaaatcagaagtatcaaaaagacaagatcagataagaaaagagcagagcgat</u> |
| | <u>taacaatacttgcccgtataaaccgttatgaaaatttatcgagagttgaaaaaagccgtctggatgatttcag</u> |
| | <u>gagttttattgcataaacaggcaattgcaaaacatgctgtacttgagcaggagaataaatatgtcgaggcagc</u> |
| | <u>aaatgaattacgggtttataaatcgcaactggagcaaattgagagtgagatattgtctgcaaaagaagaata</u> |
| | <u>tcagcttgtcacgcagcttttttaaaaatgaaattttagacaagctaagcaaacaacagacaacattgagtta</u> |
| | <u>ttaactctggagttagagaaaaatgaagagcgtcaacaggcttcagtaatcaggcccctgtttcgggaaaa</u> |
| | <u>gttcagcaactgaaggttcatactgaaggtgggttgttacaacagcggaaacactgatggtcatcgttccgg</u> |
| | <u>aagatgacacgctggaggttactgctctggtacaaaataaagatattggttttattaacgtcgggcagaatgc</u> |
| | <u>catcattaaagtggaggcctttccttacaccccgatatggttatctggtgggtaaggtgaaaaatataaatttag</u> |
| | <u>atgcaatagaagaccagaaactgggactcgttttttaatgtcattgtttctgttgttgaagagaatgatttgtcaacc</u> |
| | <u>gggaataagcacattccattaagctcgggtatggctgtcactgcagaaataaagactggaatgcgaagcgt</u>a |
| | atcagctatcttcttagtcctctggaagagtctgtaacagaaagtttacatgagcgttaag*gtctcagagccgcg* |
| | *gtatccggctcatatcttctcctg* |
| anti PD-1 scFv; Heavy Chain-linker-Light Chain transcribed from the native ptet (tetracycline responsive) promoter and with an optimized ribosome binding site expressed as fusion protein with the 53 amino acids of the C termini of alpha-hemolysin (hlyA) of E. coli CFT073. SEQ ID NO: 793 | <u>MQVQLVESGGGVVQPGRSLRLDCKASGITFSNSGMHWVRQAPGKGLEWVAVIWYDG</u><br><u>SKRYYADSVKGRFTISRDNSKNTLFLQMNSLRAEDTAVYYCATNDDYWGQGTLVTVSS</u>G<br>GGSGGGSGGGSGGG<u>EIVLTQSPATLSLSPGERATLSCRASQSVSSYLAWYQQKPGQAPR</u><br><u>LLIYDASNRATGIPARFSGSGSGTDFTLTISSLEPEDFAVYYCQQSSNWPRTFGQGTKVEIK</u><br>lnplineiskiisaagnfdvkeeraaasllqlsqnasdfsygrnsitltasa* |

TABLE 73-continued

Selected constructs with single chain antibodies for Type I Hemolysin Secretion

| Description | Sequence |
|---|---|
| anti PD-1 scFv; Codon-optimized Heavy Chain-linker-Light Chain transcribed from the native ptet (tetracycline responsive) promoter and with an optimized ribosome binding site expressed as fusion protein with the 53 amino acids of the C termini of alpha-hemolysin (hlyA) of E. coli CFT073. SEQ ID NO: 794 | gaattcgttaagacccactttcacatttaagttgttttctaatccgcatatgatcaattcaaggccgaataagaaggctgactctacaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgttttctctgtaggccgtgtacctaaatgtactttgctccatccgcgatgacttagtaaagcacatctaaaactttagcgttattacgtaaaaaatcttgccagctttcccctttctaaagggcaaaagtgagtatggtgcctatctaacatctcaatggctaaggcgtcgagcaaagcccgcttatttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcatttataqaagttaaatttaccactccctatcagtgatagaqaaaagtgaaGTTAAATTGAGGAGGAGGCAGTTCCatgcaagtacaactggttgaatccggcggaggagtggtgcaacccggccgcagtttgcgtctggattgtaaagcttcaggcatcacttttctaattctggtatgcactgggttcgccaagctccgggtaaaggtctggagtgggttgcggtgatctggtatgatggttctaaacgatattatgcggatagtgttaagggtcgttttactatttctcgtgataattctaagaacaccttgtttctgcagataataatagtctgcgcgctgaggatactgcggtatatattgtgcgactaatgacgattattggggccaaggcacgctggttaccgtgagctctggtggtggttcgggtggtggttctggtggtgggacggcggttggcgagatcgttctgactcaaagcccggcgactctgagtctgagtccgggtgaacgtgcgactctgagctgccgtgcgtctcagagtgtgcagttatctggtaccaacaaaaaccgggccaggcgccgcgactgctgatttatgatgcttctaatcgtgcgactggtgtattccggcgcgcttagcggttctggctcaggcactgacttcactctgactatttcttcgctggaaccggaagattttgcggtgtactattgtcaacaatcatctaattggcctcgtacgttcggtcaaggtacaaaagtggagataaaactaatccattaattaatgaaatcagcaaaatcatttcagctgcaggtaatttgatgttaaagagggaaagagctgcagcttctttattgcagtgtgtccggtaatgccagtgattttcatatggacggaactcaatactttgacagcatcagcataatttattaatttaaataataqcaatcttactgggctgtgccacataagattgctatttttttggagtcataatggattcttgtcataaaattgattatgggttatacgccctggagattttagcccaataccataacgtctctgttaacccggaagaaattaaacatagatttgacacagacgggactggtctgggattaacgtcatggttgcttgctgcgaaatctttagaactaaaggtaaaacaggtaaaaaaaacaattgaccgattaaactttatttctttgcccgcattagtctggagagaggatggacgtcatttattctgactaaagtcagtaaagaagcaaacagatatctttattttgatctggagcaacgaaatccccgtgttctcgaacagtctgagtttgaggcgttatatcaggggcatattattcttattgcttccgtcttctctgttaccgggaaactggcaaaatttgactttacctggtttatccctgccattataaaatacagaaaaatatttattgaaaccttgttgtatctgtttttttttacaattatttgcattaataacccccttttttttcaggtggttattggacaaagtattagtacacaggggggtttcaaccccttaatgttattactgtcgcattatctgttgtggtggtgtttgagattatactcagcggtttaagaacttacatttttgcacatagtacaagtcggattgatgttgagttgggtgccaaactcttccggcatttactggcgctaccgatctcttatttgagagtcgtcgtgttggtgatactgttgccagggtaagagaattagaccagatccgtaatttttctgacaggacaggcattaacatctgtctggacttattattttcattcatattttttcgcggtaatgttggtattacagcccaaagcttactctggtgatcttattttcgctgccctgttatgctgcatggtctgttttttattagcccattttgcgacgtcgccttgatgataagttttcacggaatgcggataatcaatctttcctggtggaatcagtcacggcgattaacactataaagctatggcagtctcacctcagatgacgaacatatgggacaaacaattggcaggatatgttgctgcaggctttaaagtgacagttagccaccattggtcaacaagcagtcagttaatacaaaaagcgttgatgatcatcaacctgtggttgggagcacacctggttattccggggatttaagtattggtcagttaattgctttaatatgcttgctggtcagattgttgcaccggttattcgccttgcacaaatctggcaggatttccagcaggttggtatatcagttacccgccttggtgatgtgcttaactctccaactgaaagttatcatgggaaactggcattaccggaaattaatggtaatatcactttcgtaatatccggtttcgctataagcctgactctccggttatttttagataatatcaatctcagtattagcaggggaggttattggtattgtcggacgttctggttcaggaaaaagcacattaactaaattaattcaacgttttatattcctgaaaatggccaggtcttaattgatggacatgatcttgcgttggccgatcctaactggttacgtcgtcaggtggggttgtgttgcaggacaatgtgctgcttaatcgcagtattattgataatatctcactggctaatcctggtatgtccgtcgaaaaagtgatttatgcagcgaaagtgctcatgcagtttcttcatttgtgcgttgaggggtataacaccattgtcggggaacaggggggcaggattatccggaggtcaacgtcaacgcatcgcaattgcaagggcgctggtgaacaaccctaaaatacttatttttgatgaagcaaccagtgctctggattatgagtcggagcatatcatcatgcgcaatatgcacaaaatatgtaagggcagaacggttataatcattgctcatcgtctgtctacagtaaaaaatgcagaccgcattattgtcatggaaaaagggaaaattgttgaacagggtaaacataaggaactgctttctgaaccggaaagtttatacagttgacttatatcagttacgactaacagaaagaacagaagaatatgaaaacatggttaatgggggttcagcgagttcctgttgcgctataaacttgtctggagtgaaacatggaaaatccggaagcaattagatactccggtacgtgaaaaggacgaaaatgaattcttacccgctcatctggaattaattgaaacgccggtatccagacggccgcgtctggttgcttattttattatgggggtttctggttattgctgtcatttttatctgttttaggtcaggtggaaattgttgccactgcaaatgggaaattaacactaagtgggcgcagcaaagaaattaaacctattgaaaactcaatagtttaaagaaattatcgtaaaagaaggagagtcagtccggaaaggggatgtgttattaaagcttacagcactgggagctgaagctgatacgttaaaaacacagtcatcactgttacagaccaggctggaacaaactcggtatcaaattctgagcaggtcaattgaattaaataaactacctgaactgaagcttcctgatgagccttattttcagaatgtatctgaagaggaaagtactgcgttaacttcttttgataaaaaagaacagttttccacatagccaaaattcagaagtatcaaaaagaactgaatctgataagaaaaagagcagagcgattaacaatacttgcccgtataaaccgttatgaaaattttcgagagttgaaaaaagccgtctggatgatttcagagtttattgcataaacaggcaattgcaaaacatgctgtacttgagcaggagataaatatgtcgaggcagcaaatgaattacgggttatcgcaaatcagcaaaattgctgcaaaagaagatattgctgcaaaagaacatcagcttgtcacgcagcttttaaaaatgaaattttagacaagctaagcaaacaacagcaacattgagttattaactctggagttagagaaaatgaagagcgtcaacaggcttcagtaatcagggcccctgtttcgggaaaagtcagcaactgaaggttcatactgaaggtgggttgttacaacagcggaaacactgatggtcatcgttccggaagatgacacgctggaggttactgctctggtacaaaataaagatattggttttatttaacgctcgggcgacagaatgccatcattaaagtggaggcctttccttacacccgatatggttatctgtgggtaaggtgaaaaaattaaattagatgcaatagaaggaccagaaactgggactcgttttaatgtcattgttctgttgaagagaatgatttgtcaacccggaataagcacattccattaagctcgggtatggctgtcactgcagaaataaagactggaatgcgaagcgtaatcagctatcttcttagtcctctggaagagtctgtaacagaaaagtttacatgagcgttaag*tctcagagccgcggtatccggctcatatcttctcctg* |
| anti PD-1 scFv; Light Chain-linker-Heavy Chain | MEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKGGGSGGGSGGGSGGGQVQLVESGGGVVQPGRSLRLDCKASGITFSNSGMHWVRQAPGKGLEWVAVIWY |

TABLE 73-continued

Selected constructs with single chain antibodies for Type I Hemolysin Secretion

| Description | Sequence |
|---|---|
| transcribed from the native ptet (tetracycline responsive) promoter and with an optimized ribosome binding site expressed as fusion protein with the 53 amino acids of the C termini of alpha-hemolysin (hlyA) of E. coli CFT073. SEQ ID NO: 795 | DGSKRYYADSVKGRFTISRDNSKNTLFLQMNSLRAEDTAVYYCATNDDYWGQGTLVTVS Slnplineiskiisaaqnfdvkeeraaasllqlsgnasdfsygrnsitltasa* |
| anti PD-1 scFv; Codon-optimized Light Chain-linker-Heavy Chain transcribed from the native ptet (tetracycline responsive) promoter and with an optimized ribosome binding site expressed as fusion protein with the 53 amino acids of the C termini of alpha-hemolysin (hlyA) of E. coli CFT073. SEQ ID NO: 796 | gaattcgttaagacccactttcacatttaagttgttttctaatccgcatatgatcaattcaaggccgaataagaa ggactgactctacaccttggtgatcaaataattcgatagcttgtcgtaataatggcggcatactatcagtagtaggt gtttcccttctcttttagcgacttgatgctcttgatcttccaatacgcaacctaaagtaaaatgcccccacagcgct gagtgcatataatgcattctctagtgaaaaaccttgttggcataaaaaggctaattgatttcgagagtttcatac tgttttttctgtaggccgtgtacctaaatgtactttttgctccatcgcgatgacttagtaaagcacatctaaaacttttta gcgttattacgtaaaaaaatcttgccagctttccccttctcaaaggggcaaaagtgagtatgqtgcctatctaacatct caatggctaaggcgtcgagcaaagcccgcttatttttttacatgccaatacaatgtaggctgctctacacctagctt ctgggcgagtttacgggtgttaaaccttcgattccgacctcattaagcagctctaatgcgctgttaatcacttttac ttttatctaatctagacatcattaattcctaattttttgttgacactctatcattttatagaqttaatttaccactccctat cagtgataqagaaaaagtgaaTATACCGAACGCTTAAGGAGGCTTTatggaaatcgtgctgactcag agtccggcgactctgtctctgagtccgggcgaacgcgcgactctgtcttgccgtgcgtctcaatctgtgtcttcat acttggcttggtaccaacaaaaaccgggccaggcgccgcgactgttgatttatgatgcgtcgaatcgcgcgac tggcattccggcgcgcttttcgggtagcggttctggtactgattttacgctgactatctcttctctggagcctgaa gatttcgctgtttattactgccaacagtctagtaattggccgcgtactttcggccagggcactaaggtggaaatt aaaggtggcggctcgggcggcggctcggtgtggtgttctggtggtggccaagtgcaagtgctgagtttgaaaagtggc ggcgggtggtgcaaccgggccgttctctgcgcctggattgtaaagcttcaggcattacttttagcaactctggt atgcactgggtcgccaagctccgggcaaaggcctggaatgggtggcggttatttggtacgatggctctaaac gttattacgctgacagtgttaaaggccgctttaccattctcgtgataattctaaaaataccctgtttctgcaaat gaactcgctgcgcgcggaagatactgctgtttactattgtgcgactaatgatgattttactggggtcaaggtaccc tggttaccgtgtcttctcttaatccattaattaatgaaatcagcaaaatcatttcagctgcaggtaattttgatgt taaagaggaaagagctgcagcttcttttattgcagttgtccggtaatgccagtgattttttcatatggacggaact caataactttgacagcatcagcataaatttattaatttaaataatagcaatcttactgggctgtgccacataagatt gctattttttggagtcataatggattcttgtcataaaattgattatgggtttatacgccctggagattttagccca ataccataacgtctctgttaacccggaagaaattaaacatagatttgacacagacgggactggtctgggatta acgtcatggttgcttgctgctgcgaaatcttttagaactaaaggtaaaacaggtaaaaaaaacaattgaccgatta aactttatttctttgcccgcattagtctggagagaggatggacgtcatttttattctgactaaagtcagtaaagaa gcaaacagatatcttattttttgatctggaagcaacgaaatccccgtgttctcgaaccagtctgagttttgaggcgtta tatcaggggcatattattcttattgcttcccgttcttctgttaccgggaaactggcaaaatttgactttaacctggtt tatccctgccattataaaatacagaaaaatatttattgaaacccttgttgtatctgttttttttacaattatttgcat taataaccccctttttttttcaggtggtttatggacaaagtattagtacacaggggttttcaacccttaatgttat tactgtcgcattatctgttgqtggtgttgagattataactcagcggtttaagaacttacatttttgcacatagt acaagtcggattgatgttgagtgggtgccaaactcttccggcatttactggcgctaccgatctcttattttgag agtcgtcgtgttggtgatactgttgccagggtaagagaattagaccagatccgtaattttctgacaggacaggc attaacatctgttctggacttattattttcattcatatttttgcgggtaatgtggtattacagcccaaagcttactc tggtgatcttattttcgctgccctgttatgctgcatggtctgttttttattagcccattttgcgacgtcgccttgatg ataagttttcacggaatgcggataatcaatcttcctggtggaatcagtcacggcgattaacactataaaagct atggcagtctcacctcagatgacgaacatatgggacaaacaattggcaggatatgttgctgcaggctttaaag tgacagtattagccaccattggtcaacaaggaatacagtaatacaaaagactgttatgatcatcaacctgtg gttgggagcacacctggttatttccggggatttaagtattggtcagttaattgcttttaatatgcttgctggtcag attgttgcacgggttattcgccttgcacaaatctggcaggattttccagcaggttggtatattcagttacccgccttg gtgatgtgcttaactctccaactgaaagttatcatgggaaactggcattaccggaaattaatggtaatatcact tttcgtaatatccggtttgctataagcctgactctccggttatttagataatatcaatctcagtattaagcagg gggaggttattggtattgtcggacgttctggttcaggaaaaagcacattaactaaattaattcaacgtttttata ttcctgaaaatggccaggtcttaattgatggacatgatcttggcctggccgatcctaactggttacgtcgtcagg tgggggttgtgttgcaggacaatgtgctgcttaatcgcagtattattgataatatctcactggctaatcctggta tgtccgtcgaaaaagttatttatgcagcgaaattagcaggcgctcatgatttttattctgaattgcgtgagggggt ataacaccattgtcggggaacaggggcaggattatccggaggtcaacgtcaacgcatcgcaattgcaaggg cgctggtgaacaacccctaaaatacttattttttgatgaagcaaccagtgctctggattatgagtcggagcatatc atcatgcgcaatatgcacaaaatatgtaagggcagaacggttataatcattgctcatcgtctgctctacagtaa aaaatgcagaccgcattattgtcatggaaaaagggaaattgttgaacagggtaaacataaggaactgcttt ctgaaccggaaagtttatacagttacttatatcagttacagtcagactaacagaaagaacagaagaatatga aaacatggttaatggggttcagcgagttcctgttgcgctataaacttgtctggagtgaaacatggaaaatccg gaagcaattagatactccggtacgtgaaaaggacgaaaatgaattcttacccgctcatctggaattaattgaa acgccggtatccagacggccgcgtctggtgcttattttattatggggtttctggttattgctgtcattttatctgtt ttaggtcaggtggaaattgttgccactgcaaatgggaaattaacactaagtgggcgcagcaaagaaattaaa cctatgaaaactcaatagttaaagaaattatcgtaaaagaaggagagtcagtccgcagcaaagggatgttgtta ttaaagcttacagcactgggagctgaagctgatacgtttaaaaaccacagtcatcactgttacagaccaggctgg aacaaactcgtatcaaattctgagcaggtcaattgaattaaataaactacctgaactgaagcttcctgatga gcctttattttcagaatgtatctgaagaggaagtactgcgtttaacttctttgataaaagaacagttttccacatg gcaaaatcagaagtatcaaaaagaactgaatctggataagaaaagagcagagcgattaacaatacttgccc gtataaaccgttatgaaaatttatcgagagtgaaaaaagccgtctggatgatttcaggagtttattgcataa |

TABLE 73-continued

Selected constructs with single chain antibodies for Type I Hemolysin Secretion

| Description | Sequence |
|---|---|
| | acaggcaattgcaaaacatgctgtacttgagcaggagaataaatatgtcgaggcagcaaatgaattacggt<br>ttataaatcgcaactggagcaaattgagagtgagatattgtctgcaaaagaagaatatcagcttgtcacgca<br>gcttttaaaaatgaaattttagacaagctaagacaaacaacagacaacattgagttattaactctggagtta<br>gagaaaaatgaagagcgtcaacaggcttcagtaatcagggcccctgttcgggaaaagttcagcaactgaag<br>gttcatactgaaggtgggtgttcaacaccgggaaacactgatggtcatcgttccggaagatgacacgctgg<br>aggttactgctctggtacaaaataaagatattggttttattaacgtcgggcagaatgccatcattaaagtggag<br>gcctttccttacacccgatatggttatctggtgggtaaggtgaaaaatataaatttagatgcaatagaagacc<br>agaaactgggactcgttttaatgtcattgtttctgttgaagagaatgatttgtcaaccgggaataagcacattc<br>cattaagctcgggtatggctgtcactgcagaaataaagactggaatgcgaagcgtaatcagctatcttcttagt<br>cctctggaagagtctgtaacagaaagtttacatgagcgttaagtctcagagccgcggtatccggctcatatct<br>tctcctg |
| anti PDL-1 scFv;<br>Heavy Chain-linker-<br>Light Chain<br>Transcribed from the<br>native ptet<br>(tetracycline<br>responsive)<br>promoter and with<br>an optimized<br>ribosome binding site<br>expressed as a fusion<br>protein with the<br>native Nissle auto-<br>secreter E. coli_01635<br>(where<br>the original<br>passenger protein<br>was replaced)<br>SEQ ID NO: 797 | MEVQLVESGGGLVQPGGSLRLSCAASGFTFSDSWIHWVRQAPGKGLEWVAWISPYGG<br>STYYADSVKGRFTISADTSKNTAYLQMNSLRAEDTAVYYCARRHWPGGFDYWGQGTLV<br>TVSSGGGSGGGSGGGSGGGDIQMTQSPSSLSASVGDRVTITCRASQDVSTAVAWYQQ<br>KPGKAPKLLIYSASFLYSGVPSRFSGSGSGTDFTLTISSLQPEDFATYYCQQYLYHPATFGQ<br>GTKVEIKRlnplineiskiisaaqnfdvkeeraaasllqlsqnasdfsyqrnsitltasa* |
| anti PDL-1 scFv;<br>Codon-optimized<br>Heavy Chain-linker-<br>Light Chain<br>Transcribed from the<br>native ptet<br>(tetracycline<br>responsive)<br>promoter and with<br>an optimized<br>ribosome binding site<br>expressed as a fusion<br>protein with the<br>native Nissle auto-<br>secreter E. coli_01635<br>(where<br>the original<br>passenger protein<br>was replaced)<br>SEQ ID NO: 798 | gaattcgttaagacccactttcacatttaagttgtttttctaatccgcatatgatcaattcaaggccgaataagaa<br>ggctggctctgcacctggtgatcaaataattcgatagcttgtcgtaataatggcggcatactatcagtagtaggt<br>gtttcccttttcttcttagcgacttgatgctcttgatcttccaatacgcaacctaaagtaaaatgcccacagcgct<br>gagtgcatataatgcattctctagtgaaaaaccttgttggcataaaaaggctaattgatttcgagagtttcatac<br>tgttttttctgtaggccgtgtacctaaatgtacttttgctccatcgcgatgacttagtaaagcacatctaaaactttta<br>gcgttattacgtaaaaacattgccagcttctccccttctaaaggggcaaaagtgagtatggtgcctatctaacatct<br>caatggctaagggcgtcgagcaaagcccgcttatttttttacatgccaatacaatgtaggctgctctacacctagctt<br>ctgggcgagtttacgggtgttaaaccttcgattccgacctcattaagcagctctaatgcgctgttaatcactttac<br>ttttatctaatctagacatcattaattcctaattttttgttgacactctatcatttatagagttaatttaccactccctat<br>cagtgatagagaaaagtgaaGATAGGGACCAGGTAAGGAGGATGAatggaagtgcagctggtgg<br>agtcaggtggaggcttggtgcaaccgggcggttcactgcgtctgtcatgtgcggcgtctgggtttactttagtg<br>actcttggattcactgggtgcgccaggctccgggtaaaggcctggaatgggtagcttggattagtcctctacggt<br>ggctcgacctatatgctgattcggtaaagggtcgctttactattagcgctgatacttctaaaaatactgcatac<br>ctgcagatgaatagcctgcgcgctgaggatactgctgtgtattattgcgcgcgtcagccactggccgggcggctt<br>tgattattggggccaaggtactctggttaccgtgtctagtggcggtggtagcggcggcggtcaggtggcggct<br>cgggcggtggcgacattcagatgactcagtctccgtcttctttgtcggcgagcgtgggcgatcgtgttaccatca<br>cgtgtcgcgcgagccaagatgtgtcgactgcggtggcttggtatcaacaaaaaccgggtaaagctccgaaact<br>gctgatttatagtcgctcttttttgtattctggtgttccgtctcgtttctctggctcaggtagcggtactgattttac<br>gctgactatttcttcactgcaaccggaagattttgctacgtattattgtcaacaatatctgtatcacccggcgac<br>gtttggtcagggtactaaggtggagataaaacgcctaatccattaattaatgaaatcagcaaaatcatttca<br>gctgcaggtaattttgatgttaaagaggaaagagctgcagcttcttattgcagttgtccggtaatgccagtga<br>tttttcatatggacggaactcaataacttgacagcatcagcataatttattaatttaaataatagcaatcttact<br>gggctgtgccacataagattgctatttttttggagtcataatggattcttgtcataaaattgattatgggttatac<br>gccctggagatttagcccaataccataacgtctctgttaacccggaagaaattaaacatagatttgacacag<br>acgggactggtctgggattaacgtcatggttgcttgctgcgaaatcttagaactaaaggtaaaacaggtaaa<br>aaaaacaattgaccgattaaactttatttcttgcccgcattagtctggagagaggatggacgtcatttttattct<br>gactaaagtcagtaaagaagcaaacagatatcttattttgatctggagcaacgaaatccccgtgttctcgaa<br>cagtctgagtttgaggcgttatatcaggggcatattattcttattgcttcccgttcttctgttaccgggaaactgg<br>caaaatttgacttacctggtttatccctgccattataaaatacagaaaaatatttattgaaacccttgttgtatc<br>tgttttttttacaattatttgcattaataaccccctttttttcaggtggttatggacaaagtattagtacacaggg<br>ggttttcaacccttaatgttattactgtcgatctctgttggtggtgttgagattatactcagcggtttaaga<br>acttacattttgcacatagtacaagtcggattgatgttgagttgggtgccaaactcttccggcatttactggcg<br>ctaccgatctcttattttgagagtcgtcgtgttggtgatactgttgccagggtaagagaattagaccagatccgt<br>aatttctgacaggacaggcattaacatctgttctggacttattattttcattcatatttttgcggtaatgtggta<br>ttacagcccaaagcttactctggtgatcttattttcgctgccctgttatgctgcatggtctgttttattagcccat<br>tttgcgacgtcgccttgatgataagttttcacggaatgcggataatcaatcttcctggtggaatcagtcacggc<br>gattaacactataaaagctatggcagtctcacctcagatgacgaacatatgggacaaacaattggcaggata<br>tgttgctgcaggctttaaagtgacagtattagccaccattggtcaacaaggaatacagtaatacaaaagact<br>gttatgatcatcaacctgtggttgggagcacacctggtttattttccggggattattggtcagttaatttgctt<br>ttaatatgcttgctggtcagattgttgcaccggttattcgccttgcacaaatctgcaggatttccagcaggttg<br>gtatatcagttacccgccttggtgatgtgcttaactctccaactgaaagttatcatgggaaactggcattaccgg<br>aaattaatggtaatatcacttttcgtaatatccggtttcgctataagcctgactctccggttattttagataatat<br>caatctcagtattaagcagggggaggttattggtattgtcggacgttctggttcaggaaaaagcacattaact<br>aaaattaattcaacgtttttatattcctgaaaatggccaggtcttaattgatggacatgatcttgcgttggccgat |

TABLE 73-continued

Selected constructs with single chain antibodies for Type I Hemolysin Secretion

| Description | Sequence |
|---|---|
| | cctaactggttacgtcgtcaggtgggggttgtgttgcaggacaatgtgctgcttaatcgcagtattattgataat<br>atctcactggctaatcctggtatgtccgtcgaaaaagttatttatgcagcgaaattagcaggcgctcatgatttt<br>atttctgaattgcgtgaggggtataacaccattgtcggggaacaggggcaggattatccggaggtcaacgtc<br>aacgcatcgcaattgcaagggcgctggtgaacaaccctaaaatacttattttttgatgaagcaaccagtgctct<br>ggattatgagtcggagcatatcatcatgcggcaatatgcacaaaatatgtaagggcagaacgttataatcatt<br>gctcatcgtctgtctacagtaaaaaatgcagaccgcattattgtcatggaaaaagggaaaattgttgaacagg<br>gtaaacataaggaactgctttctgaaccggaaagtttatacagttacttatatcagttacagtcagactaacag<br>aaagaacagaagaat<u>atgaaaacatggttaatggggttcagcgagttcctgttgcgctataaacttgtctgga<br>gtgaaacatggaaaatccggaagcaattagatactccggtacgtgaaaaggacgaaaatgaattcttacccg<br>ctcatctggaattaattgaaacgccggtatccagacggccgcgtctggttgcttattttattatgggggtttctggt<br>tattgctgtcattttatctgttttaggtcaggtggaaattgttgccactgcaaatgggaaattaacactaagtgg<br>gcgcagcaaagaaattaaacctattgaaaactcaatagttaaagaaattatcgtaaaagaaggagagtcag<br>tccggaaaggggatgtgttattaaagcttacagcactgggagctgaagctgatacgttaaaaacacagtcatc<br>actgttacagaccaggctggaacaaactcggtatcaaattctgagcaggtcaattgaattaaataaactacct<br>gaactgaagcttcctgatgagccttattttcagaatgtatctgaagaggaagtactgcgttaacttctttgata<br>aaagaacagttttccacatggcaaaatcagaagtatcaaaaagaactgaatctggataagaaaagagcag<br>agcgattaacaatacttgcccgtataaaccgttatgaaaatttatcgagagttgaaaaagccgtctggatga<br>tttcaggagtttattgcataaacaggcaattgcaaaacatgctgtacttgagcaggagaataaatatgtcgag<br>gcagcaaatgaattacgggtttataaatcgcaactggagcaaattgagagtgagatattgtctgcaaaagaa<br>gaatatcagcttgtcacgcagcttttttaaaaatgaaattttagacaagctaagacaaacaacagacaacattg<br>agttattaactctggagttagagaaaaatgaagagcgtcaacagcctcagtaatcaggcgccctgtttcggg<br>aaaagttcagcaactgaaggttcatactgaaggtgggggttgttacaacagcggaaacactgatggtcatcgtt<br>ccggaagatgacacgctgtgaggttactgctctggtacaaaataaagatattggttttattaacgtcgggcaga<br>atgccatcattaaagtggaggcctttccttacacccgatatggttatctggtgggtaaggtgaaaaatataaat<br>ttagatgcaatagaagaccagaaactgggactcgtttttaatgtcattgtttctgttgaagagaatgatttgtca<br>accgggaataagcacattccattaagctcgggtatggctgtcactgcagaaataaagactggaatgcgaagc<br>gtaatcagctatcttcttagtcctctggaagagtctgtaacagaaagtttacatgagcgttaa</u>gtctcagagcc<br>gcggtatccggctcatatcttctcctg |
| anti PDL-1 scFv; Light Chain-linker-Heavy Chain transcribed from the native ptet (tetracycline responsive) promoter and with an optimized ribosome binding site expressed as fusion protein with the 53 amino acids of the C termini of alpha-hemolysin (hlyA) of *E. coli* CFT073.<br>SEQ ID NO: 799 | MDIQMTQSPSSLSASVGDRVTITCRASQDVSTAVAWYQQKPGKAPKLLIYSASFLYSGVP<br>SRFSGSGSGTDFTLTISSLQPEDFATYYCQQYLYHPATFGQGTKVEIKRGGGSGGGSGGG<br>SGGGEVQLVESGGGLVQPGGSLRLSCAASGFTFSDSWIHWVRQAPGKGLEWVAWISP<br>YGGSTYYADSVKGRFTISADTSKNTAYLQMNSLRAEDTAVYYCARRHWPGGFDYWGQ<br>GTLVTVSSlnplineiskiisaagnfdvkeeraaasllqlsqnasdfsygrnsitltasa* |
| anti PDL-1 scFv; Codon-optimized Light Chain-linker-Heavy Chain transcribed from the native ptet (tetracycline responsive) promoter and with an optimized ribosome binding site expressed as fusion protein with the 53 amino acids of the C termini of alpha-hemolysin (hlyA) of *E. coli* CFT073.<br>SEQ ID NO: 800 | gaattcgttaagacccactttcacatttaagttgttttttctaatccgcatatgatcaattcaaggccgaataagaa<br><u>ggctggctctgcacccttggtgatcaaataattcgatagcttgtcgtaataatggcggcatactatcagtagtaggt<br>gtttccctttcttcttttagcgacttgatgctcttgatcttccaatacgcaacctaaagtaaaatgccccacagcgct<br>gagtgcatataatgcattctctagtgaaaaaccttgttggcataaaaaggctaattgattttcgagagtttcatac<br>tgttttttctgtaggccgtgtacctaaatgtacttttgctccatcgcgatgacttagtaaagcacatctaaaacttta<br>gcgttattacgtaaaaaatcttgccagctttccccttctaaagggcaaaagtgagtatggtgcctatctaacatct<br>caatggctaaggcgtcgagcaaagcccgcttatttttacatgccaatacaatgtaggctgctctacacctagctt<br>ctgggccgagtttacgggtgttaaaccttcgattccgacctcattaagcagctctaatgcgctgttaatcactttac<br>ttttatctaatctagacatcattaattcctaattttttgttgacactctatcatttatagagtttaatttaccactccctat<br>cagtgatagagaaaagtgaa</u>ATAAATCCCTTCATGAGGAGGTAAGatggatattcaaatgactca<br>atctccgagctctctgagtgcgtctgtgggtgatcgtgtgactattacttgtcgtgcgtctcaagatgtttcaact<br>gcggttgcgtggtatcaacagaaaccgggcaaggcgcctaagctgctgatttattctgcttcgttcctgtacag<br>cggtgtgccgtctcgtttctctggctctggttcgggtactgatttcactcgtgactatttcgagtctgcagccgaa<br>gatttgcacttattattgtcaacaatatctgtatcaccctgcgactttggtcaaggcacgaaagttgaaatt<br>aaacgtggtggtggctctggtggtggcagcggtggtgggtcgggtggcggtgaagttcaactggttgagtcag<br>gtggtggcctggtgcaacggggcggctctctgcgcctgtctgtgctgcgtcgggttttacgttctctgatagctg<br>gattcactggtacgccaggcaccgggcaaaggtctggaatgggtagcttggatttcacctatggtggctcta<br>cttattacgcggatagcgtgaaaggtcgctttactatttctgcggacactagcaaaaatactgcttacctgcaa<br>atgaattcgctgcgtgctgaggatactgcagtgtattactgtgcgcgtcgtcattggcctggcggctttgattatt<br>ggggtcaaggtactctggttactgttagcagctcaatccattaattaatgaaatcagcaaaatcatttcagct<br>gcaggtaattttgatgttaaagaggaaagagctgcagcttctttattgcagttgtccggtaatgccagtgatttt<br>tcatatggacggaactcaataactttgacagcatcagcataatttattaatttaaataatagcaatcttactggg<br>ctgtgccacataagattgctattttttggagtcataatggattcttgtcataaaattgattatgggttatacgccc<br>tggagatttttagcccaataccataacgtctctgttaaccccggaagaaattaaacatagatttgacacagacgg<br>gactggtctgggattaacgtcatggttgcttgctgcgaaatctttagaactaaaggtaaaacaggtaaaaaaa<br>acaattgaccgattaaactttattctcttgcccgcattagtctggagagaggatggacgtcattttattctgacta<br>aagtcagtaaagaagcaaacagatatcttattttttgatctggagcaacgaaatccccgtgttctcgaacagtct<br>gagtttgaggcgtatatcaggggcatatattcttattgcttcccgttcttctgttaccgggaaactggcaaaat<br>ttgactttacctggtttatccctgccattataaaatacagaaaaatatttattgaaaccctgttgtatctgttttt |

TABLE 73-continued

Selected constructs with single chain antibodies for Type I Hemolysin Secretion

| Description | Sequence |
|---|---|
| | ttacaattatttgcattaataaccccctttttttcaggtggttatggacaaagtattagtacacaggggttt<br>caaccctttaatgttattactgtcgcattatctgttgtggtggtgtttgagattatactcagcggtttaagaactta<br>cattttgcacatagtacaagtcggattgatgttgagttgggtgccaaactcttccggcatttactggcgctacc<br>gatctcttattttgagagtcgtcgtgttggtgatactgttgccagggtaagagaattagaccagatccgtaattt<br>tctgacaggacaggcattaacatctgttctggacttattattttcattcatatttttgcggtaatgtggtattaca<br>gcccaaagcttactctggtgatcttattttcgctgccctgttatgctgcatggtctgtttttattagcccatttgc<br>gacgtcgccttgatgataagttttcacggaatgcggataatcaatctttcctggtggaatcagtcacggcgatt<br>aacactataaaagctatggcagtctcacctcagatgacgaacatatgggacaaacaattggcaggatatgtt<br>gctgcaggctttaaagtgacagtattagccaccattggtcaacaaggaatacagttaatacaaaagactgtta<br>tgatcatcaacctgtggttgggagcacacctggttatttccggggatttaagtattggtcagttaattgcttttaa<br>tatgcttgctggtcagattgttgcaccggttattcgccttgcacaaatctggcaggatttccagcaggttggtat<br>atcagttacccgccttggtgatgtgcttaactctccaactgaaagttatcatgggaaactggcattaccggaaa<br>ttaatggtaatatcactttttcgtaatatccggtttcgctataagcctgactctccggttatttttagataatatcaat<br>ctcagtattaagcaggggggaggttattggtattgtcggacgttctggttcaggaaaaagcacattaactaaatt<br>aattcaacgttttttatattcctgaaaatggccaggtcttaattgatggacatgatcttgcgttggccgatcctaa<br>ctggttacgtcgtcaggtgggggttgtgttgcaggacaatgtgctgcttaatcgcagtattattgataatatctc<br>actggctaatcctggtatgtccgtcgaaaaagttatttatgcagcgaaattagcaggcgctcatgattttattc<br>tgaattgcgtgaggggtataacaccattgtcggggaacaggggcaggattatccggaggtcaacgtcaacg<br>catcgcaattgcaagggcgctggtgaacaacccaaaatacttatttttgatgaagcaaccagtgctctggatt<br>atgagtcggagcatatcatcatgcgcaatatgcacaaaatatgtaagggcagaacggttataatcattgctca<br>tcgtctgtctacagtaaaaaatgcagaccgcattattgtcatggaaaaagggaaaattgttgaacagggtaa<br>acataaggaactgctttctgaaccggaaagtttatacagttacttatatcagttacagtcagactaacagaaa<br>gaacagaagaatatgaaaacatggttaatggggttcagcgagttcctgttgcgctataaacttgtctggagtg<br>aaacatggaaaatccggaagcaattagatactccggtacgtgaaaaggacgaaaatgaattcttacccgctc<br>atctggaattaattgaaacgccggtatccagacggccgcgtctggttgctatttttattatgggtttctggttat<br>tgctgtcatttttatctgttttaggtcaggtggaaattgttgccactgcaaatgggaaattaacactaagtgggcg<br>cagcaaagaaattaaacctattgaaaactcaatagttaaagaaattatcgtaaaagaaggagagtcagtcc<br>ggaaagggatgtgttattaaagcttacagcactgggagctgaagctgatacgttaaaaacacagtcatcac<br>tgttacagaccaggctggaacaaactcggtatcaaattctgagcaggtcaattgaattaaataaactacctga<br>actgaagcttcctgatgagccttattttcagaatgtatctgaagaggaagtactgcgtttaacttcttttgataaa<br>agaacagttttccacatggcaaaatcagaagtatcaaaaagaactgaatctggataagaaaagagcagagc<br>gattaacaatacttgcccgtataaaccgttatgaaaatttatcgagagttgaaaaaagccgtctggatgatttc<br>aggagtttattgcataaacaggcaattgcaaaacatgctgtacttgagcaggagaataaatatgtcgagca<br>gcaaatgaattacgggtttataaatcgcaactggagcaaattgagagtgagatattgtctgcaaaagaagaa<br>tatcagcttgtcaccgcagcttttaaaaatgaaattttagacaagctaagacaaacaacagacacaacattgagt<br>tattaactctggagttagagaaaaatgaagagcgtcaacaggcttcagtaatcaggcccctgtttcgggaaa<br>agttcagcaactgaaggttcatactgaaggtgggttgttacaacagcggaaacactgatggtcatcgttccg<br>gaagatgacacgctggaggttactgctctggtacaaaataaagatattggtttattaacgtcgggcagaatg<br>ccatcattaaagtggaggcctttccttacacccgatatggttatctggtgggtaaggtgaaaaatataaattta<br>gatgcaataagaagaccagaaactgggactcgttttttaatgtcattgtttctgttgaagagaatgatttgtcaac<br>cggaataagcacattccattaagctcgggtatggctgtcactgcagaaataaagactggaatgcgaagcgt<br>aatcagctatcttcttagtcctctgaagagtctgtaacagaaagtttacatgagcgttaa<sub>gtctcagagccgc</sub><br><sub>ggtatccggctcatatcttctcctg</sub> |

Table 73 Key:
Polynucleotide Sequences:
Lowercase double underline:
Tetracycline-responsive promoter (Ptet);
UPPERCASE SINGLE UNDERLINE: Optimized Ribosome Binding Site
Bold lowercase: Protein Coding Sequence;
Bold single underline: HlyB Coding Sequence;
Bold double underline: HlyD Coding Sequence
Italics: Terminator Sequence;
Polypeptide Sequences:
Lowercase double underline: C-terminal HlyA Secretion Tag;
UPPERCASE SINGLE UNDERLINE: Light Chain;
UPPERCASE DOUBLE UNDERLINE: Heavy Chain;
UPPERCASE BOLD: Linker sequence

TABLE 74

Selected Sequences for Single Chain antibody production and secretion

| Description | Sequence |
|---|---|
| fliC promoter<br>SEQ ID NO: 801 | AGCGGGAATAAGGGGCAGAGAAAAGAGTATTTCGTCGACTAACAA<br>AAAATGGCTGTTTGTGAAAAAAATTCTAAAGGTTGTTTTACGACAGA<br>CGATAACAGGGT |
| fliC 5' untranslated region<br>SEQ ID NO: 802 | TGACGGCGATTGAGCCGACGGGTGGAAACCCAAAACGTAATCAAC |

TABLE 74-continued

Selected Sequences for Single Chain antibody production and secretion

| Description | Sequence |
|---|---|
| Tetracycline responsive promoter SEQ ID NO: 803 | ATCTAATCTAGACATCATTAATTCCTAATTTTTGTTGACACTCTATCAT TGATAGAGTTATTTTACCACTCCCTATCAGTGATAGAGAAAAGTGAA |
| Tetracycline responsive promoter SEQ ID NO: 804 | GAATTCGTTAAGACCCACTTTCACATTTAAGTTGTTTTTCTAATCCGC ATATGATCAATTCAAGGCCGAATAAGAAGGCTGGCTCTGCACCTTG GTGATCAAATAATTCGATAGCTTGTCGTAATAATGGCGGCATACTAT CAGTAGTAGGTGTTTCCCTTTCTTCTTTAGCGACTTGATGCTCTTGAT CTTCCAATACGCAACCTAAAGTAAAATGCCCCACAGCGCTGAGTGC ATATAATGCATTCTCTAGTGAAAAACCTTGTTGGCATAAAAAGGCTA ATTGATTTTCGAGAGTTTCATACTGTTTTTCTGTAGGCCGTGTACCTA AATGTACTTTTGCTCCATCGCGATGACTTAGTAAAGCACATCTAAAA CTTTTAGCGTTATTACGTAAAAAATCTTGCCAGCTTTCCCCTTCTAAA GGGCAAAAGTGAGTATGGTGCCTATCTAACATCTCAATGGCTAAGG CGTCGAGCAAAGCCCGCTTATTTTTTACATGCCAATACAATGTAGGC TGCTCTACACCTAGCTTCTGGGCGAGTTTACGGGTTGTTAAACCTTC GATTCCGACCTCATTAAGCAGCTCTAATGCGCTGTTAATCACTTTACT TTTATCTAATCTAGACATCATTAATTCCTAATTTTTGTTGACACTCTAT CATTTATAGAGTTAATTTACCACTCCCTATCAGTGATAGAGAA |
| Optimized ribosome binding site SEQ ID NO: 805 | AAATAAAAATGAGGAGGCAATTCTA |
| Optimized ribosome binding site SEQ ID NO: 806 | AGATTATAAGGAGTTAAATAGAAAA |
| Optimized ribosome binding site SEQ ID NO: 807 | CTCAAAGAATTATAGGAAAGGAGGAAGCGATAAGT |
| Optimized ribosome binding site SEQ ID NO: 808 | ATCACCAATTTGAGGAAAGGTAAAT |
| Optimized ribosome binding site SEQ ID NO: 809 | TGGCAGACGCCTAAGGAGGAAGACC |
| Optimized ribosome binding site SEQ ID NO: 810 | TACATAATTTTGGGGAGGGTACTCG |
| Optimized ribosome binding site SEQ ID NO: 811 | TTAAATATCAACTAGAGGTCACCAA |
| Optimized ribosome binding site SEQ ID NO: 812 | TACGATTTAATTCGGAGGTTTTTTG |
| Optimized ribosome binding site SEQ ID NO: 813 | TCACAACGCTGAGAGAGAGAGAAAT |
| Optimized ribosome binding site SEQ ID NO: 814 | GTTAAATTGAGGAGGAGGCAGTTCC |
| Optimized ribosome binding site SEQ ID NO: 815 | TATACCGAACGCTTAAGGAGGCTTT |
| Optimized ribosome binding site SEQ ID NO: 816 | ATAAATCCCTTCATGAGGAGGTAAG |
| Optimized ribosome binding site SEQ ID NO: 817 | GATAGGGACCAGGTAAGGAGGATGA |

TABLE 74-continued

Selected Sequences for Single Chain antibody production and secretion

| Description | Sequence |
| --- | --- |
| Terminator sequence<br>SEQ ID NO: 818 | TCGCCGTAACCTGATTAACTGAGACTGACGGCAACGCCAAATTGCCT<br>GATGCGCTGCGCTTATCAGGCCTACAAGGGGAATTGCAATTTATTG<br>AATTTGCACATTTTTGTAGGCCGGATAAGGCGTTTACGCCGCATCCG<br>GCAACATGAATGGTAATTTGCCAGCAACGTGCTTCCCCGCCAACGG<br>CGGGGTTTTTTCTG |
| Terminator sequence<br>SEQ ID NO: 819 | CTCTAACGGACTTGAGTGAGGTTGTAAAGGGAGTTGGCTCCTCGGT<br>ACCAAATTCCAGAAAAGAGGCCTCCCGAAAGGGGGGCCTTTTTTCG<br>TTTT |
| Terminator sequence<br>SEQ ID NO: 820 | GTCTCAGAGCCGCGGTATCCGGCTCATATCTTCTCCTG |
| N terminal secretion<br>tag for Type V auto-<br>secreter secretion<br>SEQ ID NO: 821 | ATGAACAAAGTATATAGCCTGAAATATTGCCCAGTAACTGGGGGTC<br>TGATTGTAGTCAGTGAACTGGCATCCCGCGTCATCAAAAAAACCTGC<br>CGTCGTCTGACTCACATCCTGCTGGCGGGTATTCCGGCTGTGTATCT<br>GTACTACCCGCAGATCTCCCAGGCAGGTATCGTCCGC |
| C terminal secretion<br>tag for Type V auto-<br>secreter secretion<br>SEQ ID NO: 822 | TTCAAAGCGGAGGCTGACAAGGCCGCTGCAGCAAAAGCTGACTCCT<br>TTATGAACGCGGGTTACAAAAACTTCATGACCGAGGTAAATAATCTC<br>AATAAACGTATGGGTGATCTGCGCGACACTAATGGGGATGCAGGC<br>GCATGGGCACGCATTATGTCTGGTGCAGGTTCGGCGGATGCGGG<br>TATTCTGACAATTACACTCATGTTCAGGTGGGCTTCGATAAAAAACA<br>TGAGCTGGACGGTGTGGATCTGTTCACTGGCGTAACCATGACTTAT<br>ACTGATTCAAGCGCAGACAGCCACGCATTTTCAGGTAAAACGAAAT<br>CAGTTGGCGGCGGTCTGTATGCGAGCGCACTGTTCGAGAGCGGCG<br>CCTACATTGATCTAATTGGCAAGTATATTCACCATGATAATGATTAC<br>ACAGGGAACTTTGCAGGCCTGGGCACCAAACACTATAACACGCATT<br>CATGGTACGCTGGCGCAGAAACCGGCTATAGATACCACCTGACCGA<br>GGAAACCTTTATCGAACCGCAAGCGGAACTGGTTTACGGTGCGGTC<br>AGTGGCAAGACCTTTCGTTGGAAAGATGGTGATATGGATCTGTCAA<br>TGAAAAACCGCGACTTCAGCCCCTTGATCGGCCGCACCGGCATTGA<br>GCTGGGCAAAACCTTCTCTGGCAAAGATTGGTCTGTTACCGCGCGT<br>GCGGGCACTTCGTGGCAATTTGATCTGCTAAACAACGGTGAGACTG<br>TACTGCGTGATGCGAGTGGCGAAAAACGTATTAAAGGTGAAAAAG<br>ATAGTAGAATGCTATTCAACGTGGGCATGAATGCGCAGATCAAAGA<br>TAACATGCGTTTTGGGTTGGAGTTTGAAAAATCCGCGTTCGGTAAAT<br>ATAATGTTGACAATGCTGTGAACGCGAATTTCCGCTACATGTTTTAA |
| Anti-CTLA-4 single<br>chain antibody<br>coding region (Heavy<br>Chain-linker-Light<br>Chain)<br>SEQ ID NO: 823 | ATGCAAGTGCAACTGGTAGAGTCCGGTGGGGGCGTGGTGCAGCCG<br>GGTCGCAGCCTGCGTCTGTCGTGCGCGGCGAGTGGTTTTACGTTTTC<br>GAGTTATACTATGCACTGGGTTCGTCAAGCGCCGGGCAAAGGCCTG<br>GAATGGGTTACTTTCATTTCTTACGATGGTAATAATAAATATTATGC<br>GGATTCTGTGAAAGGTCGCTTTACTATTTCGCGCGATAACAGTAAAA<br>ACACTCTGTATCTGCAAATGAATTCTCTGCGTGCAGAGGATACTGCT<br>ATCTATTACTGCGCGCGTACGGGCTGGTGGGCCCGTTTGATTATTG<br>GGGCCAAGGCACTTTGGTTACTGTGTCATCGGGCGGGGGCTCTGGC<br>GGTGGTTCAGGTGGTGGCAGTGGTGGTGGCGAGATCGTGTTGACT<br>CAATCTCCGGGTACTCTGTCTCTGTCTCCGGGTGAACGCGCGACCCT<br>GTCTTGCCGCGCTTCTCAGAGTGTTGTTCATCGTATCTGGCATGGT<br>ATCAACAGAAACCGGGTCAAGCGCCGCGTCTGCTGATTTACGGTGC<br>TTTTAGTCGCGCAACCGGGATTCCGGATCGATTTTCTGGTTCAGGTT<br>CTGGCACTGACTTTACTTTGACTATTAGTCGTCTGGAACCGGAGGAC<br>TTCGCGGTTTATTATTGCCAACAGTATGGTTCTTCTCCGTGGACCTTT<br>GGTCAAGGCACTAAAGTTGAAATTAAATAA |
| Anti-CTLA-4 single<br>chain antibody<br>coding region (Light<br>Chain-linker-<br>Heavy Chain)<br>SEQ ID NO: 824 | ATGGAGATTGTACTGACCCAGAGCCCTGGTACATTGTCTTTGTCGCC<br>TGGTGAACGCGCGACTCTGTCTTGTCGTGCGTCTCAGTCTGTTGGTA<br>GTTCGTATCTGGCGTGGTATCAACAAAAACCGGGCCAAGCTCCGCG<br>TCTGCTGATTTACGGTGCATTTAGCCGCGCGACTGGCATTCCGGACC<br>GCTTTTCTGGGTCTGGCTCAGGTACCGATTTTACTCTGACTATTTCGC<br>GTCTGGAGCCGGAGGATTTCGCGGTTTATTACTGCCAGCAATATGG<br>TTCTAGTCCGTGGACCTTCGGCCAAGGTACTAAAGTGGAAATCAAA<br>GGCGGGGGTTCGGGTGGTGGCTCTGGGGGTGGCTCGGGCGGTGG<br>GCAGGTGCAACTGGTTGAGAGTGGTGGCGGCGTTGTTCAACCGGG<br>CCGCTCTCTGCGCCTGTCGTGCGCTGCTTCTGGCTTTACCTTTAGCTC<br>TTATACGATGCACTGGGTTCGCCAAGCTCCGGGTAAAGGTCTGGAG<br>TGGGTGACTTTCATTTCTTACGATGGTAACAACAAATATTATGCTGA<br>TTCTGTTAAAGGCCGTTTTACTATTTCTCGAGACAATAGCAAAAACA<br>CTCTGTACCTGCAGATGAATTCTCTGCGCGCTGAAGACACCGCGATT<br>TATTATTGTGCGCGCACTGGTTGGCTGGGTCCGTTTGATTATTGGGG<br>TCAGGGCACGCTGGTTACTGTTAGCTCGTGA |

TABLE 74-continued

Selected Sequences for Single Chain antibody production and secretion

| Description | Sequence |
| --- | --- |
| Anti-PD-1 single chain antibody coding region (Heavy Chain-linker-Light Chain) SEQ ID NO: 825 | ATGCAGGTGCAATTGGTGGAGTCGGGTGGCGGCGTGGTGCAACCG GGTCGTAGCCTGCGCCTGGATTGTAAAGCGTCAGGCATCACGTTTA GCAATTCTGGCATGCACTGGGTGCGTCAAGCGCCGGGCAAAGGTCT GGAGTGGGTTGCGGTAATTTGGTACGATGGTTCTAAACGCTATTAC GCGGATAGTGTGAAAGGTCGCTTTACTATCTCTCGCGATAATTCTAA AAACACCCTGTTTCTGCAAATGAATTCGTTGCGTGCGGAAGATACTG CGGTATATTATTGTGCTACTAACGATGATTATTGGGGTCAAGGCACC CTGGTGACTGTTTCGAGCGGCGGTGGTAGCGGCGGCGGCTCTGGT GGTGGTTCTGGTGGCGGTGAGATTGTGCTGACTCAAAGCCCGGCG ACCCTGTCTCTGTCGCCGGGTGAACGCGCTACTCTGAGTTGCCGTGC GTCGCAAAGCGTGTCTTCTTATCGGCGTGGTACCAACAAAAACCG GGTCAAGCGCCGCGCCTGCTGATATATGATGCTAGTAATCGTGCAA CGGGTATTCCGGCACGCTTTTCAGGTTCTGGCAGCGGCACCGATTTC ACTCTGACTATCTCGTCACTGGAGCCGGAAGACTTTGCGGTTTATTA TTGTCAGCAATCTTCTAATTGGCCGCGTACGTTTGGTCAGGGCACTA AAGTTGAAATCAAATAA |
| Anti-PD-1 single chain antibody coding region (Light Chain-linker-Heavy Chain) SEQ ID NO: 826 | ATGGAAATCGTTTTAACGCAGTCGCCGGCGACTCTGTCTTTGTCGCC TGGTGAACGTGCTACGCTGTCTTGCCGCGCGTCACAGTCTGTGTCGT CATATCTGGCTTGGTACCAACAGAAACCGGGCCAAGCTCCGCGCCT GCTGATTTATGATGCGTCTAATCGCGACCGGCATTCCGGCGCGTT TTTCTGGCTCCGGCTCTGGCACCGACTTTACTCTGACTATTTCGTCTC TGGAACCGGAAGATTTTGCGGTGTACTATTGCCAGCAATCTTCTAAT TGGCCGCGCACGTTTGGTCAAGGTACCAAGGTTGAGATCAAAGGTG GTGGCTCGGGCGGCGGTTCGGGCGGCGGCTCAGGTGGTGGCCAAG TTCAGTTGGTTGAGTCTGGCGGGGGCGTAGTACAACCGGGTCGTTC TTTGCGTCTGGATTGCAAAGCGAGCGGTATTACCTTTAGCAATTCAG GTATGCACTGGGTGCGCCAAGCGCCGGGCAAAGGCCTGGAATGGG TTGCGGTGATTTGGTACGATGGCTCGAAACGTTATTATGCTGACAG CGTTAAAGGTCGTTTTACTATTAGCCGTGATAATTCCAAAAATACGC TGTTTCTGCAGATGAATAGCCTGCGTGCTGAAGACACTGCGGTTTAT TACTGTGCTACTAATGATGATTACTGGGGCCAGGGCACCCTGGTGA CTGTGAGTTCTTAA |
| Anti-PD-L1 single chain antibody coding region (Light Chain-linker-Heavy Chain) SEQ ID NO: 827 | ATGGATATTCAGATGACTCAGAGCCCTAGCTCACTGTCTGCGTCAGT TGGCGATCGTGTGACTATTACCTGTCGCGCTAGTCAGGATGTGTCTA CGGCGGTTGCGTGGTATCAACAGAAACCGGGCAAAGCTCCGAAACT GTTGATTTATTCAGCGTCTTTCCTGTATTCGGGTGTGCCTTCTCGCTT TTCGGGCTCTGGTAGCGGTACTGATTTTACGCTGACTATTAGTTCAC TGCAACCGGAGGACTTTGCGACTTATTATTGCCAACAATACCTGTAT CACCCGGCGACCTTTGGTCAAGGCACTAAAGTGGAAATTAAACGCG GCGGCGGCAGCGGTGGCGGCTCTGGTGGTGGGTCTGGTGGTGGTG AGGTTCAGCTGGTTGAGTCTGGTGGTGGTCTGGTTCAACCTGGGGG CAGCCTGCGCCTGTCGTGCGCGGCGTCTGGTTTTACGTTCTCAGATT CTTGGATTCACTGGGTACGTCAAGCTCCGGGCAAAGGTCTGGAGTG GGTGGCGTGGATTTCTCCGTATGGCGGTTCGACGTATTACGCGGAC TCTGTTAAAGGGCGTTTTACGATCTCAGCGGATACTTCTAAAAATAC TGCGTATCTGCAAATGAATTCTCTGCGAGCGGAGGATACCGCGGTG TATTACTGTGCTCGCCGCCACTGGCCTGGTGGTTTCGATTATTGGGG TCAAGGTACCCTGGTGACTGTTTCGTCTTAA |
| Anti-PD-L1 single chain antibody coding region (Heavy Chain-linker-Light Chain) SEQ ID NO: 828 | ATGGAAGTTCAGCTGGTGGAGAGTGGTGGCGGTCTGGTGCAGCCG GGCGGCTCTCTGCGTCTGAGCTGTGCGGCGTCTGGCTTTACGTTTTC TGACAGTTGGATTCACTGGGTGCGCCAAGCACCGGGCAAAGGCCT GGAGTGGGTGGCGTGGATTTCTCCGTATGGCGGTAGTACTTATTAT GCTGATTCTGTGAAAGGCCGTTTTACCATTTCGGCGGACACTTCAAA AAATACCGCGTATCTGCAAATGAATAGCCTGCGCGCTGAAGACACG GCTGTTTACTACTGTGCTCGCCGCCACTGGCCGGGCGGTTTCGATTA TTGGGGCCAAGGCACTCTGGTGACTGTGAGCTCTGGCGGCGGGTC GGGTGGCGGTTCTGGCGGTGGCAGTGGCGGTGGTGATATTCAAAT GACCCAATCTCCGTCGTCTCTGAGCGCGTCTGTGGGCGATCGTGTA ACCATTACTTGTCGTGCGTCGCAGGATGTGCTACTGCTGTGGCGTG GTATCAGCAAAAACCGGGTAAAGCTCCGAAACTGCTGATTTATAGC GCTTCTTTTCTGTATAGTGGTGTTCCGTCACGTTTTAGCGGTTCAGGC TCTGGTACTGATTTCACACTGACTATTTCTTCTGCAACCGGAAGAT TTCGCGACTTATTATTGTCAGCAGTACTTGTACCACCCGGCAACTTTT GGTCAGGGCACTAAAGTTGAAATTAAACGTTAA |
| Anti-CTLA-4 single chain antibody coding region (Heavy Chain-linker-Light Chain) with N | ATGAACAAAGTATATAGCCTGAAATATTGCCCAGTAACTGGGGGTC TGATTGTAGTCAGTGAACTGGCATCCCGCGTCATCAAAAAAACCTGC CGTCGTCTGACTCACATCCTGCTGGCGGGTATTCCGGCTGTGTATCT GTACTACCCGCAGATCTCCCAGGCAGGTATCGTCCGCCAGGTACAA TTAGTTGAGAGCGGCGGCGGTGTGGTTCAACCGGGCCGTAGTCTGC |

TABLE 74-continued

Selected Sequences for Single Chain antibody production and secretion

| Description | Sequence |
|---|---|
| terminal and C terminal Secretion Tag for Type V auto-secreter SEQ ID NO: 829 | GATTGTCTTGTGCTGCATCTGGTTTTACTTTCAGTTCTTACACGATGC ACTGGGTTCGCCAAGCTCCGGGCAAAGGCCTGGAGTGGGTTACCTT TATTTCTTACGATGGCAATAATAAGTATTACGCTGATTCTGTGAAAG GTCGCTTTACTATTAGCCGAGATAACTCTAAAAATACTCTGTATCTG CAAATGAATTCTCTGCGTGCGGAAGATACTGCGATCTATTATTGTGC GCGTACTGGTTGGCTGGGCCCGTTTGATTATTGGGGCCAAGGCACG CTGGTTACTGTTAGTTCGGGCGGCGGTTCTGGTGGCGGCTCTGGTG GTGGCTCTGGCGGCGGCGAGATTGTGCTGACTCAATCTCCGGGCAC GCTGTCACTGTCTCCGGGTGAACGCGCGACCCTGTCTTGTCGCGCG AGTCAAAGTGTTGGTTCTTCTTATCTGGCTTGGTATCAGCAAAAGCC TGGTCAAGCGCCGCGTCTGTTGATTTATGGCGCGTTTTCGCGCGCG ACTGGCATTCCGGACCGATTTTCTGGTTCTGGTTCTGGCACTGATTT CACTCTGACCATTTCACGCCTGGAACCGGAGGATTTTGCGGTGTACT ATTGCCAACAATATGGCTCATCGCCGTGGACGTTTGGCCAAGGTAC TAAAGTTGAGATTAAATTCAAAGCGGAGGCTGACAAGGCCGCTGCA GCAAAAGCTGACTCCTTTATGAACGCGGGTTACAAAAACTTCATGAC CGAGGTAAATAATCTCAATAAACGTATGGGTGATCTGCGCGACACT AATGGGGATGCAGGCGCATGGGCACGCATTATGTCTGGTGCAGGT TCGGCGGATGGCGGGTATTCTGACAATTACACTCATGTTCAGGTGG GCTTCGATAAAAAACATGAGCTGGACGGTGTGGATCTGTTCACTGG CGTAACCATGACTTATACTGATTCAAGCGCAGACAGCCACGCATTTT CAGGTAAAACGAAATCAGTTGGCGGCGGTCTGTATGCGAGCGCACT GTTCGAGAGCGGCGCCTACATTGATCTAATTGGCAAGTATATTCACC ATGATAATGATTACACAGGGAACTTTGCAGGCCTGGGCACCAAACA CTATAACACGCATTCATGGTACGCTGGCGCAGAAACCGGCTATAGA TACCACCTGACCGAGGAAACCTTTATCGAACCGCAAGCGGAACTGG TTTACGGTGCGGTCAGTGGCAAGACCTTTCGTTGGAAAGATGGTGA TATGGATCTGTCAATGAAAAACCGCGACTTCAGCCCCTTGATCGGCC GCACCGGCATTGAGCTGGGCAAAAACCTTCTCTGGCAAAGATTGGTC TGTTACCGCGCGTGCGGGCACTTCGTGGCAATTTGATCTGCTAAACA ACGGTGAGACTGTACTGCGTGATGCGAGTGGCGAAAAACGTATTAA AGGTGAAAAGATAGTAGAATGCTATTCAACGTGGGCATGAATGC GCAGATCAAAGATAACATGCGTTTTGGGTTGGAGTTTGAAAAATCC GCGTTCGGTAAATATAATGTTGACAATGCTGTGAACGCGAATTTCC GCTACATGTTTTAA |
| Anti-CTLA-4 single chain antibody coding region (Light Chain-linker-Heavy Chain) with N terminal and C terminal Secretion Tag for Type V auto-secreter SEQ ID NO: 830 | ATGAACAAAGTATATAGCCTGAAATATTGCCCAGTAACTGGGGGTC TGATTGTAGTCAGTGAACTGGCATCCCGCGTCATCAAAAAAACCTGC CGTCGTCTGACTCACATCCTGCTGGCGGGTATTCCGGCTGTGTATCT GTACTACCCGCAGATCTCCCAGGCAGGTATCGTCCGCGAAATTGTA CTGACCCAGTCGCCTGGTACCCTGTCTCTGTCGCCGGGTGAACGTGC TACCCTGTCTTGTCGTGCTTCGCAATCGGTTGGCTCGTCTGCTTGGC ATGGTATCAGCAAAAACCGGGCCAAGCGCCTCGTCTGCTGATTTAT GGCGCGTTTTCTCGTGCTACGGGCATTCCTGATCGTTTTTCGGGCTC TGGCTCTGGTACTGATTTTACGCTGACTATCAGCCGCTTGGAACCTG AAGATTTTGCGGTTTATTATTGCCAACAATATGGCTCTTCTCCGGTG ACGTTTGGTCAAGGCACTAAAGTTGAAATTAAAGGTGGTGGCTCGG GCGGTGGTTCTGGTGGTGGTAGTGGTGGTGGTCAAGTGCAGTTGG TTGAATCGGGTGGCGGTGTTGTGCAGCCGGGCCGTTCGTTGCGTCT GTCTTGCGCAGCGAGTGGTTTCACCTTCTCTTCTTATACTATGCACTG GGTGCGTCAAGCACCTGGCAAAGGTCTGGAGTGGGTAACTTTTATT TCATACGATGGTAATAATAAATATTATGCAGATTCTGTTAAAGGTCG CTTTACGATTTCTCGCGATAATTCAAAAAATACGCTGTATCTGCAGA TGAATTCGCTGCGCGCTGAGGATACTGCGATCTACTATTGTGCGCGT ACTGGTTGGCTGGGTCCGTTTGATTACTGGGGCCAAGGTACGCTGG TTACAGTTTCGTCGTTCAAAGCGGAGGCTGACAAGGCCGCTGCAGC AAAAGCTGACTCCTTTATGAACGCGGGTTACAAAAACTTCATGACCG AGGTAAATAATCTCAATAAACGTATGGGTGATCTGCGCGACACTAA TGGGGATGCAGGCGCATGGGCACGCATTATGTCTGGTGCAGGTTC GGCGGATGGCGGGTATTCTGACAATTACACTCATGTTCAGGTGGGC TTCGATAAAAAACATGAGCTGGACGGTGTGGATCTGTTCACTGGCG TAACCATGACTTATACTGATTCAAGCGCAGACAGCCACGCATTTTCA GGTAAAACGAAATCAGTTGGCGGCGGTCTGTATGCGAGCGCACTGT TCGAGAGCGGCGCCTACATTGATCTAATTGGCAAGTATATTCACCAT GATAATGATTACACAGGGAACTTTGCAGGCCTGGGCACCAAACACT ATAACACGCATTCATGGTACGCTGGCGCAGAAACCGGCTATAGATA CCACCTGACCGAGGAAACCTTTATCGAACCGCAAGCGGAACTGGTT TACGGTGCGGTCAGTGGCAAGACCTTTCGTTGGAAAGATGGTGATA TGGATCTGTCAATGAAAAACCGCGACTTCAGCCCCTTGATCGGCCG CACCGGCATTGAGCTGGGCAAAAACCTTCTCTGGCAAAGATTGGTCT GTTACCGCGCGTGCGGGCACTTCGTGGCAATTTGATCTGCTAAACA ACGGTGAGACTGTACTGCGTGATGCGAGTGGCGAAAAACGTATTAA AGGTGAAAAGATAGTAGAATGCTATTCAACGTGGGCATGAATGC GCAGATCAAAGATAACATGCGTTTTGGGTTGGAGTTTGAAAAATCC GCGTTCGGTAAATATAATGTTGACAATGCTGTGAACGCGAATTTCC GCTACATGTTTTAA |

TABLE 74-continued

Selected Sequences for Single Chain antibody production and secretion

| Description | Sequence |
|---|---|
| Anti-PD-1 single chain antibody coding region (Heavy Chain-linker-Light Chain) with N terminal and C terminal Secretion Tag for Type V auto-secreter SEQ ID NO: 831 | ATGAACAAAGTATATAGCCTGAAATATTGCCCAGTAACTGGGGGTC TGATTGTAGTCAGTGAACTGGCATCCCGCGTCATCAAAAAAACCTGC CGTCGTCTGACTCACATCCTGCTGGCGGGTATTCCGGCTGTGTATCT GTACTACCCGCAGATCTCCCAGGCAGGTATCGTCCGCCAAGTACAA CTGGTTGAATCCGGCGGAGGAGTGGTGCAACCGGGCCGCAGTTTG CGTCTGGATTGTAAAGCTTCAGGCATCACTTTTTCTAATTCTGGTATG CACTGGGTTCGCCAAGCTCCGGGTAAAGGTCTGGAGTGGGTTGCG GTGATCTGGTATGATGGTTCTAAACGATATTATGCGGATAGTGTTAA GGGTCGTTTTACTATTTCTCGTGATAATTCTAAGAACACCTTGTTTCT GCAGATGAATAGTCTGCGCGCTGAGGATACTGCGGTATATTATTGT GCGACTAATGACGATTATTGGGGCCAAGGCACGCTGGTTACCGTGA GCTCTGGTGGTGGTTCGGGTGGTGGTTCTGGTGGTGGGAGCGGCG GTGGCGAGATCGTTCTGACTCAAAGCCCGGCGACTCTGAGTCTGAG TCCGGGTGAACGTGCGACTCTGAGCTGCCGTGCGTCTCAGAGTGTG TCGAGTTATCTGGCGTGGTACCAACAAAAACCGGGCCAGGCGCCGC GACTGCTGATTTATGATGCTTTCTAATCGTGCGACTGGTATTCCGGCG CGCTTTAGCGGTTCTGGCTCAGGCACTGACTTCACTCTGACTATTTCT TCGCTGGAACCGGAAGATTTTGCGGTGTACTATTGTCAACAATCATC TAATTGGCCTCGTACGTTCGGTCAAGGTACAAAAGTGGAGATAAAA TTCAAAGCGGAGGCTGACAAGGCCGCTGCAGCAAAAGCTGACTCCT TTATGAACGCGGGTTACAAAAACTTCATGACCGAGGTAAATAATCTC AATAAACGTATGGGTGATCTGCGCGACACTAATGGGGATGCAGGC GCATGGGCACGCATTATGTCTGGTGCAGGTTCGGCGGATGGCGGG TATTCTGACAATTACACTCATGTTCAGGTGGGCTTCGATAAAAAACA TGAGCTGGACGGTGTGGATCTGTTCACTGGCGTAACCATGACTTAT ACTGATTCAAGCGCAGACAGCCACGCATTTTCAGGTAAAACGAAAT CAGTTGGCGGCGGTCTGTATGCGAGCGCACTGTTCGAGAGCGGCG CCTACATTGATCTAATTGGCAAGTATATTCACCATGATAATGATTAC ACAGGGAACTTTGCAGGCCTGGGCACCAAACACTATAACACGCATT CATGGTACGCTGGCGCAGAAACCGGCTATAGATACCACCTGACCGA GGAAACCTTTATCGAACCGCAAGCGGAACTGGTTTACGGTGCGGTC AGTGGCAAGACCTTTCGTTGGAAAGATGGTGATATGGATCTGTCAA TGAAAAACCGCGACTTCAGCCCCTTGATCGGCCGCACCGGCATTGA GCTGGGCAAAACCTTCTCTGGCAAAGATTGGTCTGTTACCGCGCGT GCGGGCACTTCGTGGCAATTTGATCTGCTAAACAACGGTGAGACTG TACTGCGTGATGCGAGTGGCGAAAAACGTATTAAAGGTGAAAAAG ATAGTAGAATGCTATTCAACGTGGGCATGAATGCGCAGATCAAAGA TAACATGCGTTTTGGGTTGGAGTTTGAAAAATCCGCGTTCGGTAAAT ATAATGTTGACAATGCTGTGAACGCGAATTTCCGCTACATGTTTTAA |
| Anti-PD-1 single chain antibody coding region (Light Chain-linker-Heavy Chain) with N terminal and C terminal Secretion Tag for Type V auto-secreter SEQ ID NO: 832 | ATGAACAAAGTATATAGCCTGAAATATTGCCCAGTAACTGGGGGTC TGATTGTAGTCAGTGAACTGGCATCCCGCGTCATCAAAAAAACCTGC CGTCGTCTGACTCACATCCTGCTGGCGGGTATTCCGGCTGTGTATCT GTACTACCCGCAGATCTCCCAGGCAGGTATCGTCCGCGAAATCGTG CTGACTCAGAGTCCGGCGACTCTGTCTCTGAGTCCGGGCGAACGCG CGACTCTGTCTTGCCGTGCGTCTCAATCTGTGTCTTCATACTTGGCTT GGTACCAACAAAAACCGGGCCAGGCGCCGCGACTGTTGATTTATGA TGCGTCGAATCGCGCGACTGGCATTCCGGCGCGCTTTTCGGGTAGC GGTTCTGGTACTGATTTTACGCTGACTATCTCTTCTCTGGAGCCTGA AGATTTCGCTGTTTATTACTGCCAACAGTCTAGTAATTGGCCGCGTA CTTTCGGCCAGGGCACTAAGGTGGAAATTAAAGGTGGCGGCTCGG GCGGCGGCTCGGGTGGTGGTTCTGGTGGTGGCCAAGTGCAACTGG TGGAAAGTGGCGGCGGGGTGGTGCAACCGGGCCGTTCTCTGCGCC TGGATTGTAAAGCTTCAGGCATTACTTTTAGCAACTCTGGTATGCAC TGGGTTCGCCAAGCTCCGGGCAAAGGCCTGGAATGGGTGCGGTT ATTTGGTACGATGGCTCTAAACGTTATTACGCTGACAGTGTTAAAGG CCGCTTTACCATTTCTCGTGATAATTCTAAAAATACCCTGTTTCTGCA AATGAACTCGCTGCGCGCGGAAGATACTGCTGTTTACTATTGTGCG ACTAATGATGATTACTGGGGTCAAGGTACCCTGGTTACCGTGTCTTC TTTCAAAGCGGAGGCTGACAAGGCCGCTGCAGCAAAAGCTGACTCC TTTATGAACGCGGGTTACAAAAACTTCATGACCGAGGTAAATAATCT CAATAAACGTATGGGTGATCTGCGCGACACTAATGGGGATGCAGGC GCATGGGCACGCATTATGTCTGGTGCAGGTTCGGCGGATGGCGGG TATTCTGACAATTACACTCATGTTCAGGTGGGCTTCGATAAAAAACA TGAGCTGGACGGTGTGGATCTGTTCACTGGCGTAACCATGACTTAT ACTGATTCAAGCGCAGACAGCCACGCATTTTCAGGTAAAACGAAAT CAGTTGGCGGCGGTCTGTATGCGAGCGCACTGTTCGAGAGCGGCG CCTACATTGATCTAATTGGCAAGTATATTCACCATGATAATGATTAC ACAGGGAACTTTGCAGGCCTGGGCACCAAACACTATAACACGCATT CATGGTACGCTGGCGCAGAAACCGGCTATAGATACCACCTGACCGA GGAAACCTTTATCGAACCGCAAGCGGAACTGGTTTACGGTGCGGTC AGTGGCAAGACCTTTCGTTGGAAAGATGGTGATATGGATCTGTCAA TGAAAAACCGCGACTTCAGCCCCTTGATCGGCCGCACCGGCATTGA GCTGGGCAAAACCTTCTCTGGCAAAGATTGGTCTGTTACCGCGCGT GCGGGCACTTCGTGGCAATTTGATCTGCTAAACAACGGTGAGACTG |

TABLE 74-continued

Selected Sequences for Single Chain antibody production and secretion

| Description | Sequence |
|---|---|
| | TACTGCGTGATGCGAGTGGCGAAAAACGTATTAAAGGTGAAAAAG |
| | ATAGTAGAATGCTATTCAACGTGGGCATGAATGCGCAGATCAAAGA |
| | TAACATGCGTTTTGGGTTGGAGTTTGAAAAATCCGCGTTCGGTAAAT |
| | ATAATGTTGACAATGCTGTGAACGCGAATTTCCGCTACATGTTTTAA |
| Anti-PD-L1 single chain antibody coding region (Light Chain-linker-Heavy Chain) with N terminal and C terminal Secretion Tag for Type V auto-secreter SEQ ID NO: 833 | ATGAACAAAGTATATAGCCTGAAATATTGCCCAGTAACTGGGGGTC TGATTGTAGTCAGTGAACTGGCATCCCGCGTCATCAAAAAAACCTGC CGTCGTCTGACTCACATCCTGCTGGCGGGTATTCCGGCTGTGTATCT GTACTACCCGCAGATCTCCCAGGCAGGTATCGTCCGCGATATTCAAA TGACTCAATCTCCGAGCTCTCTGAGTGCGTCTGTGGGTGATCGTGTG ACTATTACTTGTCGTGCGTCTCAAGATGTTTCAACTGCGGTTGCGTG GTATCAACAGAAACCGGGCAAGGCGCCTAAGCTGCTGATTTATTCT GCTTCGTTCCTGTACAGCGGTGTGCCGTCTCGTTTCTCTGGCTCTGG TTCGGGTACTGATTTCACTCTGACTATTTCGAGTCTGCAGCCGGAAG ATTTTGCGACTTATTATTGTCAACAATATCTGTATCACCCTGCGACGT TTGGTCAAGGCACGAAAGTTGAAATTAAACGTGGTGGTGGCTCTGG TGGTGGCAGCGGTGGTGGGTCGGGTGGCGGTGAAGTTCAACTGGT TGAGTCAGGTGGTGGCCTGGTGCAACCGGGCGGCTCTCTGCGCCTG TCTTGTGCTGCGTCGGGTTTTACGTTCTCTGATAGCTGGATTCACTG GGTACGCCAGGCACCGGGCAAAGGTCTGGAATGGGTAGCTTGGAT TTCACCTTATGGTGGCTCTACTTATTACGCGGATAGCGTGAAAGGTC GCTTTACTATTTCTGCGGACACTAGCAAAAATACTGCTTACCTGCAA ATGAATTCGCTGCGTGCTGAGGATACTGCAGTGTATTACTGTGCGC GTCGTCATTGGCCTGGCGGCTTTGATTATTGGGGTCAAGGTACTCTG GTTACTGTTAGCAGCTTCAAAGCGGAGGCTGACAAGGCCGCTGCAG CAAAAGCTGACTCCTTTATGAACGCGGGTTACAAAAACTTCATGACC GAGGTAAATAATCTCAATAAACGTATGGGTGATCTGCGCGACACTA ATGGGGATGCAGGCGCATGGGCACGCATTATGTCTGGTGCAGGTTC GGCGGATGGCGGGTATTCTGACAATTACACTCATGTTCAGGTGGGC TTCGATAAAAAACATGAGCTGGACGGTGTGGATCTGTTCACTGGCG TAACCATGACTTATACTGATTCAAGCGCAGACAGCCACGCATTTTCA GGTAAAACGAAATCAGTTGGCGGCGGTCTGTATGCGAGCGCACTGT TCGAGAGCGGCGCCTACATTGATCTAATTGGCAAGTATATTCACCAT GATAATGATTACACAGGGAACTTTGCAGGCCTGGGCACCAAACACT ATAACACGCATTCATGGTACGCTGGCGCAGAAACCGGCTATAGATA CCACCTGACCGAGGAAACCTTTATCGAACCGCAAGCGGAACTGGTT TACGGTGCGGTCAGTGGCAAGACCTTTCGTTGGAAAGATGGTGATA TGGATCTGTCAATGAAAAACCGCGACTTCAGCCCCTTGATCGGCCG CACCGGCATTGAGCTGGGCAAAAACCTTCTCTGGCAAAGATTGGTCT GTTACCGCGCGTGCGGGCACTTCGTGGCAATTTGATCTGCTAAACA ACGGTGAGACTGTACTGCGTGATGCGAGTGGCGAAAAACGTATTAA AGGTGAAAAAGATAGTAGAATGCTATTCAACGTGGGCATGAATGC GCAGATCAAAGATAACATGCGTTTTGGGTTGGAGTTTGAAAAATCC GCGTTCGGTAAATATAATGTTGACAATGCTGTGAACGCGAATTTCC GCTACATGTTTTAA |
| Anti-PD-L1 single chain antibody coding region (Heavy Chain-linker-Light Chain) with N terminal and C terminal Secretion Tag for Type V auto-secreter SEQ ID NO: 834 | ATGAACAAAGTATATAGCCTGAAATATTGCCCAGTAACTGGGGGTC TGATTGTAGTCAGTGAACTGGCATCCCGCGTCATCAAAAAAACCTGC CGTCGTCTGACTCACATCCTGCTGGCGGGTATTCCGGCTGTGTATCT GTACTACCCGCAGATCTCCCAGGCAGGTATCGTCCGCGAAGTGCAG CTGGTGGAGTCAGGTGGAGGCTTGGTGCAACCGGGCGGTTCACTG CGTCTGTCATGTGCGGCGTCTGGGTTTACTTTTAGTGACTCTTGGAT TCACTGGGTGCGCCAGGCTCCGGGTAAAGGCCTGGAATGGGTAGC TTGGATTAGTCCTTACGGTGGCTCGACCTATTATGCTGATTCGGTAA AGGGTCGCTTTACTATTAGCGCTGATACTTCTAAAAATACTGCATAC CTGCAGATGAATAGCCTGCGCGCTGAGGATACTGCTGTGTATTATT GCGCGCGTCGCCACTGGCCGGGCGGCTTTGATTATTGGGGCCAAG GTACTCTGGTTACCGTGTCTAGTGGCGGTGGTAGCGGCGGCGGCTC AGGTGGCGGCTCGGGCGGTGGCGACATTCAGATGACTCAGTCTCC GTCTTCTTTGTCGGCGAGCGTGGGCGATCGTGTTACCATCACGTGTC GCGCGAGCCAAGATGTGTCGACTGCGGTGGCTTGGTATCAACAAAA ACCGGGTAAAGCTCCGAAACTGCTGATTTATAGTGCGTCTTTTTTGT ATTCTGGTGTTCCGTCTCGTTTCTCTGGCTCAGGTAGCGGTACTGAT TTTACGCTGACTATTTCTTCACTGCAACCGGAAGATTTTGCTACGTAT TATTGTCAACAATATCTGTATCACCCGGCGACGTTTGGTCAGGGTAC TAAGGTGGAGATAAAACGCTTCAAAGCGGAGGCTGACAAGGCCGC TGCAGCAAAAGCTGACTCCTTTATGAACGCGGGTTACAAAAACTTCA TGACCGAGGTAAATAATCTCAATAAACGTATGGGTGATCTGCGCGA CACTAATGGGGATGCAGGCGCATGGGCACGCATTATGTCTGGTGCA GGTTCGGCGGATGGCGGGTATTCTGACAATTACACTCATGTTCAGG TGGGCTTCGATAAAAAACATGAGCTGGACGGTGTGGATCTGTTCAC TGGCGTAACCATGACTTATACTGATTCAAGCGCAGACAGCCACGCA TTTTCAGGTAAAACGAAATCAGTTGGCGGCGGTCTGTATGCGAGCG CACTGTTCGAGAGCGGCGCCTACATTGATCTAATTGGCAAGTATATT CACCATGATAATGATTACACAGGGAACTTTGCAGGCCTGGGCACCA AACACTATAACACGCATTCATGGTACGCTGGCGCAGAAACCGGCTA |

TABLE 74-continued

Selected Sequences for Single Chain antibody production and secretion

| Description | Sequence |
|---|---|
| | TAGATACCACCTGACCGAGGAAACCTTTATCGAACCGCAAGCGGAA<br>CTGGTTTACGGTGCGGTCAGTGGCAAGACCTTTCGTTGGAAAGATG<br>GTGATATGGATCTGTCAATGAAAAACCGCGACTTCAGCCCCTTGATC<br>GGCCGCACCGGCATTGAGCTGGGCAAAACCTTCTCTGGCAAAGATT<br>GGTCTGTTACCGCGCGTGCGGGCACTTCGTGGCAATTTGATCTGCTA<br>AACAACGGTGAGACTGTACTGCGTGATGCGAGTGGCGAAAAACGT<br>ATTAAAGGTGAAAAGATAGTAGAATGCTATTCAACGTGGGCATGA<br>ATGCGCAGATCAAAGATAACATGCGTTTTGGGTTGGAGTTTGAAAA<br>ATCCGCGTTCGGTAAATATAATGTTGACAATGCTGTGAACGCGAATT<br>TCCGCTACATGTTTTAA |
| Anti-CTLA-4 single<br>chain antibody<br>coding region (Heavy<br>Chain-linker-Light<br>Chain) for type I<br>hemolysin secretion,<br>including HlyA tag<br>SEQ ID NO: 835 | ATGCAGGTACAATTAGTTGAGAGCGGCGGCGGTGTGGTTCAACCG<br>GGCCGTAGTCTGCGATTGTCTTGTCGTGCATCTGGTTTTACTTTCAGT<br>TCTTACACGATGCACTGGGTTCGCCAAGCTCCGGGCAAAGGCCTGG<br>AGTGGGTTACCTTTATTTCTTACGATGGCAATAATAAGTATTACGCT<br>GATTCTGTGAAAGGTCGCTTTACTATTAGCCGAGATAACTCTAAAAA<br>TACTCTGTATCTGCAAATGAATTCTCTGCGTGCGGAAGATACTGCGA<br>TCTATTATTGTGCGCGTACTGGTTGGCTGGGCCCGTTTGATTATTGG<br>GGCCAAGGCACGCTGGTTACTGTTAGTTCGGGCGGCGGTTCTGGTG<br>GCGGCTCTGGTGGTGGCTCTGGCGGCGGCGAGATTGTGCTGACTCA<br>ATCTCCGGGCACGCTGTCACTGTCTCCGGGTGAACGCGCGACCCTG<br>TCTTGTCGCGCGAGTCAAAGTGTTGGTTCTTCTTATCTGGCTTGGTA<br>TCAGCAAAAGCCTGGTCAAGCGCCGCGTCTGTTGATTTATGGCGCG<br>TTTTCGCGCGCGACTGGCATTCCGGACCGATTTTCTGGTTCTGGTTC<br>TGGCACTGATTTCACTCTGACCATTTCACGCCTGGAACCGGAGGATT<br>TTGCGGTGTACTATTGCCAACAATATGGCTCATCGCCGTGGACGTTT<br>GGCCAAGGTACTAAAGTTGAGATTAAACTTAATCCATTAATTAATGA<br>AATCAGCAAAATCATTTCAGCTGCAGGTAATTTTGATGTTAAAGAGG<br>AAAGAGCTGCAGCTTCTTTATTGCAGTTGTCCGGTAATGCCAGTGAT<br>TTTTCATATGGACGGAACTCAATAACTTTGACAGCATCAGCATAA |
| Anti-CTLA-4 single<br>chain antibody<br>coding region (Light<br>Chain-linker-<br>Heavy Chain) for type<br>I hemolysin secretion,<br>including HlyA tag<br>SEQ ID NO: 836 | ATGGAAATTGTACTGACCCAGTCGCCTGGTACCCTGTCTCTGTCGCC<br>GGGTGAACGTGCTACCCTGTCTTGTCGTGCTTCGCAATCGGTTGGCT<br>CGTCTTATCTGGCATGGTATCAGCAAAAACCGGGCCAAGCGCCTCG<br>TCTGCTGATTTATGGCGCGTTTTCTCGTGCTACGGGCATTCCTGATC<br>GTTTTTCGGGCTCTGGCTCTGGTACTGATTTTACGCTGACTATCAGC<br>CGCTTGGAACCTGAAGATTTTGCGGTTTATTATTGCCAACAATATGG<br>CTCTTCTCCGTGGACGTTTGGTCAAGGCACTAAAGTTGAAATTAAAG<br>GTGGTGGCTCGGGCGGTGGTTCTGGTGGTGGTAGTGGTGGTGGTC<br>AAGTGCAGTTGGTTGAATCGGGTGGCGGTGTTGTGCAGCCGGGCC<br>GTTCGTTGCGTCTGTCTTGCGCAGCGAGTGGTTTCACCTTCTCTTCTT<br>ATACTATGCACTGGGTGCGTCAAGCACCTGGCAAAGGTCTGGAGTG<br>GGTAACTTTTATTTCATACGATGGTAATAATAAATATTATGCAGATT<br>CTGTTAAAGGTCGCTTTACGATTTCTCGCGATAATTCAAAAAATACG<br>CTGTATCTGCAGATGAATTCGCTGCGCGCTGAGGATACTGCGATCT<br>ACTATTGTGCGCGTACTGGTTGGCTGGGTCCGTTTGATTACTGGGG<br>CCAAGGTACGCTGGTTACAGTTTCGTCGCTTAATCCATTAATTAATG<br>AAATCAGCAAAATCATTTCAGCTGCAGGTAATTTTGATGTTAAAGAG<br>GAAAGAGCTGCAGCTTCTTTATTGCAGTTGTCCGGTAATGCCAGTG<br>ATTTTTCATATGGACGGAACTCAATAACTTTGACAGCATCAGCATAA |
| Anti-PD-1 single chain<br>antibody coding<br>region (Heavy Chain-<br>linker-Light Chain)<br>for type I hemolysin<br>secretion, including<br>HlyA tag<br>SEQ ID NO: 837 | ATGCAAGTACAACTGGTTGAATCCGGCGGAGGAGTGGTGCAACCG<br>GGCCGCAGTTTGCGTCTGGATTGTAAAGCTTCAGGCATCACTTTTTC<br>TAATTCTGGTATGCACTGGGTTCGCCAAGCTCCGGGTAAAGGTCTG<br>GAGTGGGTTGCGGTGATCTGGTATGATGGTTCTAAACGATATTATG<br>CGGATAGTGTTAAGGGTCGTTTTACTATTTCTCGTGATAATTCTAAG<br>AACACCTTGTTTCTGCAGATGAATAGTCTGCGCGCTGAGGATACTGC<br>GGTATATTATTGTGCGACTAATGACGATTATTGGGGCCAAGGCACG<br>CTGGTTACCGTGAGCTCTGGTGGTGGTTCGGGTGGTGGTTCTGGTG<br>GTGGGAGCGGCGGTGGCGAGATCGTTCTGACTCAAAGCCCGGCGA<br>CTCTGAGTCTGAGTCCGGGTGAACGTGCGACTCTGAGCTGCCGTGC<br>GTCTCAGAGTGTGTCGAGTTATCTGGCGTGGTACCAACAAAAACCG<br>GGCCAGGCGCCGCGACTGCTGATTTATGATGCTTCTAATCGTGCGA<br>CTGGTATTCCGGCGCGCTTTAGCGGTTCTGGCTCAGGCACTGACTTC<br>ACTCTGACTATTCTTCGCTGGAACCGGAAGATTTTGCGGTGTACTA<br>TTGTCAACAATCATCTAATTGGCCTCGTACGTTCGGTCAAGGTACAA<br>AAGTGGAGATAAAACTTAATCCATTAATTAATGAAATCAGCAAATC<br>ATTTCAGCTGCAGGTAATTTTGATGTTAAAGAGGAAAGAGCTGCAG<br>CTTCTTTATTGCAGTTGTCCGGTAATGCCAGTGATTTTTCATATGGAC<br>GGAACTCAATAACTTTGACAGCATCAGCATAA |
| Anti-PD-1 single chain<br>antibody coding<br>region (Light Chain-<br>linker-Heavy Chain)<br>for type I hemolysin | ATGGAAATCGTGCTGACTCAGAGTCCGGCGACTCTGTCTCTGAGTC<br>CGGGCGAACGCGCGACTCTGTCTTGCCGTGCGTCTCAATCTGTGTCT<br>TCATACTTGGCTTGGTACCAACAAAAACCGGGCCAGGCGCCGCGAC<br>TGTTGATTTATGATGCGTCGAATCGCGCGACTGGCATTCCGGCGCG<br>CTTTTCGGGTAGCGGTTCTGGTACTGATTTTACGCTGACTATCTCTTC |

TABLE 74-continued

Selected Sequences for Single Chain antibody production and secretion

| Description | Sequence |
|---|---|
| secretion, including HlyA tag SEQ ID NO: 838 | TCTGGAGCCTGAAGATTTCGCTGTTTATTACTGCCAACAGTCTAGTA<br>ATTGGCCGCGTACTTTCGGCCAGGGCACTAAGGTGGAAATTAAAGG<br>TGGCGGCTCGGGCGGCGGCTCGGGTGGTGGTTCTGGTGGTGGCCA<br>AGTGCAACTGGTGGAAAGTGGCGGCGGGGTGGTGCAACCGGGCC<br>GTTCTCTGCGCCTGGATTGTAAAGCTTCAGGCATTACTTTTAGCAAC<br>TCTGGTATGCACTGGGTTCGCCAAGCTCCGGGCAAAGGCCTGGAAT<br>GGGTGGCGGTTATTTGGTACGATGGCTCTAAACGTTATTACGCTGA<br>CAGTGTTAAAGGCCGCTTTACCATTTCTCGTGATAATTCTAAAAATA<br>CCCTGTTTCTGCAAATGAACTCGCTGCGCGCGGAAGATACTGCTGTT<br>TACTATTGTGCGACTAATGATGATTACTGGGGTCAAGGTACCCTGGT<br>TACCGTGTCTTCTCTTAATCCATTAATTAATGAAATCAGCAAAATCAT<br>TTCAGCTGCAGGTAATTTTGATGTTAAAGAGGAAAGAGCTGCAGCT<br>TCTTTATTGCAGTTGTCCGGTAATGCCAGTGATTTTTCATATGGACG<br>GAACTCAATAACTTTGACAGCATCAGCATAA |
| Anti-PD-L1 single chain antibody coding region (Light Chain-linker-Heavy Chain) for type I hemolysin secretion, including HlyA tag SEQ ID NO: 839 | ATGGATATTCAAATGACTCAATCTCCGAGCTCTCTGAGTGCGTCTGT<br>GGGTGATCGTGTGACTATTACTTGTCGTGCGTCTCAAGATGTTTCAA<br>CTGCGGTTGCGTGGTATCAACAGAAACCGGGCAAGGCGCCTAAGCT<br>GCTGATTTATTCTGCTTCGTTCCTGTACAGCGGTGTGCCGTCTCGTTT<br>CTCTGGCTCTGGTTCGGGTACTGATTTCACTCTGACTATTTCGAGTCT<br>GCAGCCGGAAGATTTTGCGACTTATTATTGTCAACAATATCTGTATC<br>ACCCTGCGACGTTTGGTCAAGGCACGAAAGTTGAAATTAAACGTGG<br>TGGTGGCTCTGGTGGTGGCAGCGGTGGTGGGTCGGGTGGCGGTGA<br>AGTTCAACTGGTTGAGTCAGGTGGTGGCCTGGTGCAACCGGGCGG<br>CTCTCTGCGCCTGTCTTGTGCTGCGTCGGGTTTTACGTTCTCTGATAG<br>CTGGATTCACTGGGTACGCCAGGCACCGGGCAAAGGTCTGGAATG<br>GGTAGCTTGGATTTCACCTTATGGTGGCTCTACTTATTACGCGGATA<br>GCGTGAAAGGTCGCTTTACTATTTCTGCGGACACTAGCAAAAATACT<br>GCTTACCTGCAAATGAATTCGCTGCGTGCTGAGGATACTGCAGTGT<br>ATTACTGTGCGCGTCGTCATTGGCCTGGCGGCTTTGATTATTGGGGT<br>CAAGGTACTCTGGTTACTGTTAGCAGCCTTAATCCATTAATTAATGA<br>AATCAGCAAAATCATTTCAGCTGCAGGTAATTTTGATGTTAAAGAGG<br>AAAGAGCTGCAGCTTCTTTATTGCAGTTGTCCGGTAATGCCAGTGAT<br>TTTTCATATGGACGGAACTCAATAACTTTGACAGCATCAGCATAA |
| Anti-PD-L1 single chain antibody coding region (Heavy Chain-linker-Light Chain) for type I hemolysin secretion, including HlyA tag SEQ ID NO: 840 | ATGGAAGTGCAGCTGGTGGAGTCAGGTGGAGGCTTGGTGCAACCG<br>GGCGGTTCACTGCGTCTGTCATGTGCGGCGTCTGGGTTTACTTTTAG<br>TGACTCTTGGATTCACTGGGTGCGCCAGGCTCCGGGTAAAGGCCTG<br>GAATGGGTAGCTTGGATTAGTCCTTACGGTGGCTCGACCTATTATGC<br>TGATTCGGTAAAGGGTCGCTTTACTATTAGCGCTGATACTTCTAAAA<br>ATACTGCATACCTGCAGATGAATAGCCTGCGCGCTGAGGATACTGC<br>TGTGTATTATTGCGCGCGTCGCCACTGGCCGGGCGGCTTTGATTATT<br>GGGGCCAAGGTACTCTGGTTACCGTGTCTAGTGGCGGTGGTAGCG<br>GCGGCGGCTCAGGTGGCGGCTCGGGCGGTGGCGACATTCAGATGA<br>CTCAGTCTCCGTCTTCTTTGTCGGCGAGCGTGGGCGATCGTGTTACC<br>ATCACGTGTCGCGCGAGCCAAGATGTGTCGACTGCGGTGGCTTGGT<br>ATCAACAAAAACCGGGTAAAGCTCCGAAACTGCTGATTTATAGTGC<br>GTCTTTTTTGTATTCTGGTGTTCCGTCTCGTTTCTCTGGCTCAGGTAG<br>CGGTACTGATTTTACGCTGACTATTTCTTCACTGCAACCGGAAGATT<br>TTGCTACGTATTATTGTCAACAATATCTGTATCACCCGGCGACGTTT<br>GGTCAGGGTACTAAGGTGGAGATAAAACGCCTTAATCCATTAATTA<br>ATGAAATCAGCAAAATCATTTCAGCTGCAGGTAATTTTGATGTTAAA<br>GAGGAAAGAGCTGCAGCTTCTTTATTGCAGTTGTCCGGTAATGCCA<br>GTGATTTTTCATATGGACGGAACTCAATAACTTTGACAGCATCAGCA<br>TAA |
| C terminal HlyA secretion Tag SEQ ID NO: 841 | CTTAATCCATTAATTAATGAAATCAGCAAAATCATTTCAGCTGCAGG<br>TAATTTTGATGTTAAAGAGGAAAGAGCTGCAGCTTCTTTATTGCAGT<br>TGTCCGGTAATGCCAGTGATTTTTCATATGGACGGAACTCAATAACT<br>TTGACAGCATCAGCATAA |
| HlyB coding sequence SEQ ID NO: 842 | ATGGATTCTTGTCATAAAATTGATTATGGGTTATACGCCCTGGAGAT<br>TTTAGCCCAATACCATAACGTCTCTGTTAACCCGGAAGAAATTAAAC<br>ATAGATTTGACACAGACGGGACTGGTCTGGGATTAACGTCATGGTT<br>GCTTGCTGCGAAATCTTTAGAACTAAAGGTAAAACAGGTAAAAAAA<br>ACAATTGACCGATTAAACTTTATTTCTTTGCCCGCATTAGTCTGGAG<br>AGAGGATGGACGTCATTTTATTCTGACTAAAGTCAGTAAAGAAGCA<br>AACAGATATCTTATTTTTGATCTGGAGCAACGAAATCCCCGTGTTCT<br>CGAACAGTCTGAGTTTGAGGCGTTATATCAGGGGCATATTATTCTTA<br>TTGCTTCCCGTTCTTCTGTTACCGGGAAACTGGCAAAATTTGACTTTA<br>CCTGGTTTATCCCTGCCATTATAAAATACAGAAAAATATTTATTGAA<br>ACCCTTGTTGTATCTGTTTTTTTACAATTATTTGCATTAATAACCCCCC<br>TTTTTTTTCAGGTGGTTATGGACAAAGTATTAGTACACAGGGGGTTT<br>TCAACCCTTAATGTTATTACTGTCGCATTATCTGTTGTGGTGGTGTTT<br>GAGATTATACTCAGCGGTTTAAGAACTTACATTTTTGCACATAGTAC<br>AAGTCGGATTGATGTTGAGTTGGGTGCCAAACTCTTCCGGCATTTAC |

TABLE 74-continued

Selected Sequences for Single Chain antibody production and secretion

| Description | Sequence |
|---|---|
| | TGGCGCTACCGATCTCTTATTTTGAGAGTCGTCGTGTTGGTGATACT GTTGCCAGGGTAAGAGAATTAGACCAGATCCGTAATTTTCTGACAG GACAGGCATTAACATCTGTTCTGGACTTATTATTTTCATTCATATTTT TTGCGGTAATGTGGTATTACAGCCCAAAGCTTACTCTGGTGATCTTA TTTTCGCTGCCCTGTTATGCTGCATGGTCTGTTTTTATTAGCCCCATT TTGCGACGTCGCCTTGATGATAAGTTTTCACGGAATGCGGATAATCA ATCTTTCCTGGTGGAATCAGTCACGGCGATTAACACTATAAAAGCTA TGGCAGTCTCACCTCAGATGACGAACATATGGGACAAACAATTGGC AGGATATGTTGCTGCAGGCTTTAAAGTGACAGTATTAGCCACCATT GGTCAACAAGGAATACAGTTAATACAAAAGACTGTTATGATCATCA ACCTGTGGTTGGGAGCACACCTGGTTATTTCCGGGGATTTAAGTATT GGTCAGTTAATTGCTTTTAATATGCTTGCTGGTCAGATTGTTGCACC GGTTATTCGCCTTGCACAAATCTGGCAGGATTTCCAGCAGGTTGGTA TATCAGTTACCCGCCTTGGTGATGTGCTTAACTCTCCAACTGAAAGT TATCATGGGAAACTGGCATTACCGGAAATTAATGGTAATATCACTTT TCGTAATATCCGGTTTCGCTATAAGCCTGACTCTCCGGTTATTTTAGA TAATATCAATCTCAGTATTAAGCAGGGGAGGTTATTGGTATTGTC GGACGTTCTGGTTCAGGAAAAAGCACATTAACTAAATTAATTCAAC GTTTTTATATTCCTGAAAATGGCCAGGTCTTAATTGATGGACATGAT CTTGCGTTGGCCGATCCTAACTGGTTACGTCGTCAGGTGGGGGTTG TGTTGCAGGACAATGTGCTGCTTAATCGCAGTATTATTGATAATATC TCACTGGCTAATCCTGGTATGTCCGTCGAAAAAGTTATTTATGCAGC GAAATTAGCAGGCGCTCATGATTTTATTTCTGAATTGCGTGAGGGG TATAACACCATTGTCGGGGAACAGGGGCAGGATTATCCGGAGGT CAACGTCAACGCATCGCAATTGCAAGGGCGCTGGTGAACAACCCTA AAATACTTATTTTTGATGAAGCAACCAGTGCTCTGGATTATGAGTCG GAGCATATCATCATGCGCAATATGCACAAAATATGTAAGGGCAGAA CGGTTATAATCATTGCTCATCGTCTGTCTACAGTAAAAAATGCAGAC CGCATTATTGTCATGGAAAAAGGGAAATTGTTGAACAGGGTAAAC ATAAGGAACTGCTTTCTGAACCGGAAAGTTTATACAGTTACTTATAT CAGTTACAGTCAGACTAA |
| HlyD coding sequence SEQ ID NO: 843 | ATGAAAACATGGTTAATGGGGTTCAGCGAGTTCCTGTTGCGCTATA AACTTGTCTGGAGTGAAACATGGAAAATCCGGAAGCAATTAGATAC TCCGGTACGTGAAAAGGACGAAAATGAATTCTTACCCGCTCATCTG GAATTAATTGAAACGCCGGTATCCAGACGGCCGCGTCTGGTTGCTT ATTTTATTATGGGGTTTCTGGTTATTGCTGTCATTTTATCTGTTTTAG GTCAGGTGGAAATTGTTGCCACTGCAAATGGGAAATTAACACTAAG TGGGCGCAGCAAAGAAATTAAACCTATTGAAAACTCAATAGTTAAA GAAATTATCGTAAAAGAAGGAGAGTCAGTCCGGAAAGGGGATGTG TTATTAAAGCTTACAGCACTGGGAGCTGAAGCTGATACGTTAAAAA CACAGTCATCACTGTTACAGACCAGGCTGGAACAAACTCGGTATCA AATTCTGAGCAGGTCAATTGAATTAAATAAACTACCTGAACTGAAGC TTCCTGATGAGCCTTATTTTCAGAATGTATCTGAAGAGGAAGTACTG CGTTTAACTTCTTTGATAAAAGAACAGTTTTCCACATGGCAAAATCA GAAGTATCAAAAAGAACTGAATCTGGATAAGAAAAGAGCAGAGCG ATTAACAATACTTGCCCGTATAAACCGTTATGAAAATTTATCGAGAG TTGAAAAAAGCCGTCTGGATGATTTCAGGAGTTTATTGCATAAACA GGCAATTGCAAAACATGCTGTACTTGAGCAGGAGAATAAATATGTC GAGGCAGCAAATGAATTACGGGTTTATAAATCGCAACTGGAGCAAA TTGAGAGTGAGATATTGTCTGCAAAAGAAGAATATCAGCTTGTCAC GCAGCTTTTTAAAAATGAAATTTTAGACAAGCTAAGACAAACAACA GACAACATTGAGTTATTAACTCTGGAGTTAGAGAAAAATGAAGAGC GTCAACAGGCTTCAGTAATCAGGGCCCCTGTTTCGGGAAAAGTTCA GCAACTGAAGGTTCATACTGAAGGTGGGGTTGTTACAACAGCGGAA ACACTGATGGTCATCGTTCCGGAAGATGACACGCTGGAGGTTACTG CTCTGGTACAAAATAAAGATATTGGTTTTATTAACGTCGGGCAGAAT GCCATCATTAAAGTGGAGGCCTTTCCTTACACCCGATATGGTTATCT GGTGGGTAAGGTGAAAAATATAAATTTAGATGCAATAGAAGACCA GAAACTGGGACTCGTTTTTAATGTCATTGTTTCTGTTGAAGAGAATG ATTTGTCAACCGGGAATAAGCACATTCCATTAAGCTCGGGTATGGCT GTCACTGCAGAAATAAAGACTGGAATGCGAAGCGTAATCAGCTATC TTCTTAGTCCTCTGGAAGAGTCTGTAACAGAAAGTTTACATGAGCGT TAA |

TABLE 75

Selected sequences for single chain antibody production and secretion

| Description | Sequence |
|---|---|
| Anti-CTLA-4 Heavy<br>SEQ ID NO: 844 | MQVQLVESGGGVVQPGRSLRLSCAASGFTFSSYTMHWVRQAPGKG<br>LEWVTFISYDGNNKYYADSVKGRFTISRDNSKNTLYLQMNSLRAEDTA<br>IYYCARTGWLGPFDYWGQGTLVTVSS |
| Anti-CTLA-4 Light<br>SEQ ID NO: 845 | EIVLTQSPGTLSLSPGERATLSCRASQSVGSSYLAWYQQKPGQAPRLLI<br>YGAFSRATGIPDRFSGSGSGTDFTLTISRLEPEDFAVYYCQQYGSSPWT<br>FGQGTKVEIK |
| Anti-PD-1 Heavy<br>SEQ ID NO: 846 | MQVQLVESGGGVVQPGRSLRLDCKASGITFSNSGMHWVRQAPGKG<br>LEWVAVIWYDGSKRYYADSVKGRFTISRDNSKNTLFLQMNSLRAEDT<br>AVYYCATNDDYWGQGTLVTVSS |
| Anti-PD-1 Light<br>SEQ ID NO: 847 | EIVLTQSPATLSLSPGERATLSCRASQSVSSYLAWYQQKPGQAPRLLIY<br>DASNRATGIPARFSGSGSGTDFTLTISSLEPEDFAVYYCQQSSNWPRTF<br>GQGTKVEIK |
| Anti-PD-L1 Light<br>SEQ ID NO: 848 | MDIQMTQSPSSLSASVGDRVTITCRASQDVSTAVAWYQQKPGKAPK<br>LLIYSASFLYSGVPSRFSGSGSGTDFTLTISSLQPEDFATYYCQQYLYHPA<br>TFGQGTKVEIKR |
| Anti-PD-L1 Heavy<br>SEQ ID NO: 849 | EVQLVESGGGLVQPGGSLRLSCAASGFTFSDSWIHWVRQAPGKGLE<br>WVAWISPYGGSTYYADSVKGRFTISADTSKNTAYLQMNSLRAEDTAV<br>YYCARRHWPGGFDYWGQGTLVTVSS |
| Linker<br>SEQ ID NO: 850 | GGGSGGGSGGGSGGG |
| N Terminal Secretion Tag For Type V Autosecreter Secretion<br>SEQ ID NO: 851 | MNKVYSLKYCPVTGGLIVVSELASRVIKKTCRRLTHILLAGIPAVYLYYP<br>QISQAGIVR |
| C Terminal Secretion Tag For Type V Autosecreter Secretion<br>SEQ ID NO: 852 | FKAEADKAAAAKADSFMNAGYKNFMTEVNNLNKRMGDLRDTNGD<br>AGAWARIMSGAGSADGGYSDNYTHVQVGFDKKHELDGVDLFTGVT<br>MTYTDSSADSHAFSGKTKSVGGGLYASALFESGAYIDLIGKYIHHDNDY<br>TGNFAGLGTKHYNTHSWYAGAETG |
| C-Terminal HlyA Secretion Tag<br>SEQ ID NO: 853 | LNPLINEISKIISAAGNFDVKEERAAASLLQLSGNASDFSYGRNSITLTAS<br>A* |
| HlyB<br>SEQ ID NO: 854 | MDSCHKIDYGLYALEILAQYHNVSVNPEEIKHRFDTDGTGLGLTSWLL<br>AAKSLELKVKQVKKTIDRLNFISLPALVWREDGRHFILTKVSKEANRYLI<br>FDLEQRNPRVLEQSEFEALYQGHIILIASRSSVTGKLAKFDFTWFIPAIIK<br>YRKIFIETLVVSVFLQLFALITPLFFQVVMDKVLVHRGFSTLNVITVALSV<br>VVVFEIILSGLRTYIFAHSTSRIDVELGAKLFRHLLALPISYFESRRVGDTV<br>ARVRELDQIRNFLTGQALTSVLDLLFSFIFFAVMWYYSPKLTLVILFSLPC<br>YAAWSVFISPILRRRLDDKFSRNADNQSFLVESVTAINTIKAMAVSPQ<br>MTNIWDKCILAGYVAAGFKVTVLATIGQQGIQLIQKTVMIINLWLGAH<br>LVISGDLSIGQLIAFNMLAGQIVAPVIRLAQIWQDFQQVGISVTRLGD<br>VLNSPTESYHGKLALPEINGNITFRNIRFRYKPDSPVILDNINLSIKQGEV<br>IGIVGRSGSGKSTLTKLIQRFYIPENGQVLIDGHDLALADPNWLRRQVG<br>VVLQDNVLLNRSIIDNISLANPGMSVEKVIYAAKLAGAHDFISELREGY<br>NTIVGEQGAGLSGGQRQRIAIARALVNNPKILIFDEATSALDYESEHIIM<br>RNMHKICKGRTVIIIAHRLSTVKNADRIIVMEKGKIVEQGKHKELLSEPE<br>SLYSYLYQLQSD* |
| HlyD<br>SEQ ID NO: 855 | MKTWLMGFSEFLLRYKLVWSETWKIRKQLDTPVREKDENEFLPAHLE<br>LIETPVSRRPRLVAYFIMGFLVIAVILSVLGQVEIVATANGKLTLSGRSKE<br>IKPIENSIVKEIIVKEGESVRKGDVLLKLTALGAEADTLKTQSSLLQTRLE<br>QTRYQILSRSIELNKLPELKLPDEPYFQNVSEEEVLRLTSLIKEQFSTWQ<br>NQKYQKELNLDKKRAERLTILARINRYENLSRVEKSRLDDFRSLLHKQAI<br>AKHAVLEQENKYVEAANELRVYKSQLEQIESEILSAKEEYQLVTQLFKN<br>EILDKLRQTTDNIELLTLELEKNEERQQASVIRAPVSGKVQQLKVHTEG<br>GVVTTAETLMVIVPEDDTLEVTALVQNKDIGFINVGQNAIIKVEAFPYT<br>RYGYLVGKVKNINLDAIEDQKLGLVFNVIVSVEENDLSTGNKHIPLSSG<br>MAVTAEIKTGMRSVISYLLSPLEESVTESLHER* |

Single-chain antibodies or antibody fragments may be generated using the heavy and light chain variable regions and/or sequences disclosed in Tables 69-71 For example, PCR products corresponding to the heavy and light chain variable regions may be amplified, and spliced together with an intervening flexible peptide linker sequence. Non-limiting examples of polypeptide linkers that may be incorporated between the heavy and light chain variable region sequences include NH$_2$-GGGGSGGGGSGGGGS-COOH (SEQ ID NO: 1050) and NH$_2$-SSADDAKKDAAKKD-DAKKDDAKKDAS-COOH (SEQ ID NO: 1051) (Griffin et al., 2002).

Modifications to the sequences disclosed in Tables 69-71, such as modifications to the complementarity determining regions and/or framework regions, may be designed in order to improve binding affinity for the target epitope (e.g., to lower $K_D$) and increase suitability for expression of a single-chain antibody from a bacterial cell.

The gene encoding the single-chain anti-CTLA-4 antibody or single-chain anti-PD-1 antibody is expressed under the control of each of the following promoters: a constitutive promoter, a tetracycline-inducible promoter with the tet repressor (TetR) expressed constitutively on a plasmid, or a FNR promoter selected from SEQ ID NOs: 1-12. As discussed herein, other promoters may be used.

Tables 71-73 describe non-limiting examples of constructs for the expression and secretion of single chain antibodies.

The construct encoding the single-chain anti-CTLA-4 antibody or single-chain anti-PD-1 antibody is expressed on a high-copy plasmid, a low-copy plasmid, or a chromosome.

For chromosomal expression, the insertion site may be anywhere in the genome, e.g., in a gene required for survival and/or growth (to create an auxotroph); in an active area of the genome, such as near the site of genome replication; and/or in between divergent promoters in order to reduce the risk of unintended transcription.

Example 2. Construction and Conjugation of Expression Vector

To enable *Clostridium*-specific expression of a single-chain anti-CTLA-4 antibody or a single-chain anti-PD-1 antibody, DNA encoding the antibody of interest is amplified from relevant constructs by standard PCR. Forward and reverse oligonucleotide primers used for amplification may also be used to introduce SfiI and BstEII restriction sites, respectively. Purified PCR products are then analyzed by agarose gel electrophoresis and cloned into a SfiI- and BstEII-digested pMTL-555 shuttle vector with Myc and HIS6 epitope tags via ligation (Groot et al., 2007). Cloning is verified by sequencing. The pMTL-555-antibody constructs are transformed into an *Escherichia coli* donor strain by electroporation.

Next, transformed *E. coli* are conjugated with *C. novyi*-NT as previously described (Theys et al., 2006). Briefly, cells harvested from an overnight culture of the *E. coli* donor strain are washed in PBS before resuspension in 200 µL of an overnight culture of *C. novyi*-NT in TYG broth. The 200 µL mating mix is spotted onto a TYG+0.5% glucose (v/v) agar plate and incubated anaerobically for 7 hrs. The mating mixture is then resuspended in 500 μL of sterile PBS before plating onto selective agar (TYG+erythromycin). *E. coli* donors are counter selected by the addition of D-cycloserine (250 μg/mL) to the media.

Example 3. Verifying Transformants

Colonies of *C. novyi*-NT harboring the anti-CTLA-4 and/or anti-PD-1 single-chain antibody construct are identified using strain-specific (colony) PCR. Individual transformants may either be lysed in water with a short heating step, or added directly to the PCR reaction and lysed during the initial heating step. Heating is used to release the plasmid DNA from the cell, so that it may serve as the template for subsequent amplification reactions.

PCR amplification of the *C. novyi* flagellin (filA) gene and of the *E. coli* thymidine kinase (TK) gene may be used to demonstrate specificity of the transformation, and show that the transformed *Clostridium* strains are pure, respectively. PCR fragments are resolved by agarose gel electrophoresis.

Example 4. Isolation and Characterization of Single-Chain Antibodies

Transformed *C. novyi*-NT are grown overnight in a Coy anaerobic chamber (supplying 90% $N_2$, 5% $CO_2$, 5% $H_2$) at 37° C. Cells are then harvested, resuspended in 25 mL sonication buffer (50 mM Tris-HCl, 30 mM NaCl, pH 8.0), and lysed by sonication on ice. Unsoluble debris is spun down twice for 20 min at 12,000 rpm at 4° C.

Recombinant anti-CTLA-4 and/or anti-PD-1 single-chain antibodies are purified using immobilized metal ion affinity chromatography. Protein concentration is determined by BCA protein assay, and isolated proteins are analyzed by Western blot. Proteins transferred onto PVDF membranes are detected with an HRP-conjugated anti-HIS6 antibody.

Example 5. Enzyme-Linked Immunosorbent Assay (ELISA)

To determine whether the single-chain antibody purified from *Clostridium* functionally binds to the target protein (e.g., CTLA-4 or PD-1), plates are absorbed overnight at 4° C. with 5 μg per well of HIS6-purified single-chain antibody from *C. novyi*-NT, with a control antibody, or left empty. Wells are blocked with 2% BSA in PBS/0.1% Tween-20 for 2 hours at room temperature with shaking. After two washes, wells are incubated with 5 μg of recombinant CTLA-4 or PD-1, carrying an N-terminal T7 tag. Wells are washed 8 times with PBST (PBS/0.1% Tween-20) and incubated with a HRP-conjugated anti-T7 antibody in blocking solution for 30 min. Following incubation, wells are washed 6-8 times with PBST and once with PBS, then stained using a 3,3',5,5'-tetramethylbenzidine (TMB) substrate kit according to the manufacturer's instructions. Signal intensities are measured using an ELISA reader at 450 nm.

Example 6. Administration of *C. novyi* or *E. coli* Nissle Expressing a Construct of Interest in a Mouse Syngeneic Tumor Model for Colon Carcinoma Six to eight week old female or C57BL/6 mice are implanted with s.c. tumors through the injection of 2.5×106 CT-26 cells, respectively. When the tumors reach a volume of ~250 mm3, treatment is initiated. Bacteria, e.g., *Clostridium novyi*-NT (Dang et al., 2001) or *E. coli* Nissle 1917 expressing the construct of interest, or corresponding *Clostridium novyi*-NT or *E. coli* Nisle 1917 control (wild-type) are diluted in PBS to the appropriate concentration and administered by either intratumoral injection (100 μl volume, 1×106 bacteria) or i.v. injection (500 μl volume, 5×107 bacteria or spores) into the tail vein. A control group is injected with the same volume of PBS. Tumor growth is assessed by measuring the size of the major and minor axes of s.c. tumors every 2 days, using calipers and the tumor volume is calculated. Statistical significance is tested according to methods known in the art.

Example 7. Construction of Plasmids Comprising an Anti-CTLA4 Antibody or an Anti-PD-1 Antibody To facilitate inducible production of single-chain antibody, e.g., an anti-CTLA-4 antibody or an anti-PD-1 antibody, the polynucleotide encoding the single-chain antibody of interest, as well as transcriptional and translational elements, is synthesized (Gen9, Cambridge, Mass.) and cloned into vector pBR322. The construct encoding the single chain antibody is placed under the control of an inducible promoter. Low-copy and high-copy plasmids are generated for each of single-chain anti-CTLA-4 antibody or single-chain anti-PD-1 antibody under the control of an inducible FNR promoter or a Tet promoter. Exemplary FNR promoters are shown in Table 37 and Table 38. However, other promoters may be used to drive expression of the anti-CTLA-4 or PD1 single chain antibody of interest, or other single chain antibodies may be used.

Example 8. Transforming *E. coli*

Each of the plasmids described above is transformed into *E. coli* Nissle. All tubes, solutions, and cuvettes are pre-chilled to 4° C. An overnight culture of *E. coli* Nissle is diluted 1:100 in 5 mL of lysogeny broth (LB) containing ampicillin and grown until it reaches an $OD_{600}$ of 0.4-0.6. The *E. coli* cells are then centrifuged at 2,000 rpm for 5 min at 4° C., the supernatant is removed, and the cells are resuspended in 1 mL of 4° C. water. The *E. coli* are again centrifuged at 2,000 rpm for 5 min at 4° C., the supernatant is removed, and the cells are resuspended in 0.5 mL of 4° C. water. The *E. coli* are again centrifuged at 2,000 rpm for 5 min at 4° C., the supernatant is removed, and the cells are finally resuspended in 0.1 mL of 4° C. water. The electroporator is set to 2.5 kV. Plasmid (0.5 µg) is added to the cells, mixed by pipetting, and pipetted into a sterile, chilled cuvette. The dry cuvette is placed into the sample chamber, and the electric pulse is applied. One mL of room-temperature SOC media is added immediately, and the mixture is transferred to a culture tube and incubated at 37° C. for 1 hr. The cells are spread out on an LB plate containing ampicillin and incubated overnight.

Example 9. Production of Single Chain Antibody from Tet Promoter in Recombinant *E. coli*

For in vitro studies, all incubations are performed at 37° C. Cultures of *E. coli* Nissle transformed with a plasmid comprising the sequence encoding the single chain antibody of interest driven by the Tet promoter are grown overnight and then diluted 1:100 in LB. The cells are grown with shaking (200 rpm) to early log phase. Anhydrous tetracycline (ATC) is added to cultures at a concentration of 100 ng/mL to induce expression of the single chain antibody, and bacteria are grown for another 0, 2, and 4 hours. Bacteria are then pelleted, washed, and harvested, resuspended in 25 mL sonication buffer (50 mM Tris-HCl, 30 mM NaCl, pH 8.0), and lysed by sonication on ice. Unsoluble debris is spun down twice for 20 min at 12,000 rpm at 4° C.

Recombinant anti-CTLA-4 and/or anti-PD-1 single-chain antibodies are purified using immobilized metal ion affinity chromatography. Protein concentration is determined by BCA protein assay, and isolated proteins are analyzed by Western blot. Proteins transferred onto PVDF membranes are detected with an HRP-conjugated anti-HIS6 antibody. To determine whether the single-chain antibody purified from *E. coli* Nissle functionally binds to the target protein, an ELISA assay is performed as described in Example 5.

Example 10. Production of Single Chain Antibody from FNR Promoter in Recombinant *E. coli*

Cultures of *E. coli* Nissle transformed with a plasmid comprising the sequence encoding single chain antibody of interest driven by any of the exemplary FNR promoters described above are grown overnight and then diluted 1:200 in LB. The cells are grown with shaking at 250 rpm either aerobically or anaerobically in a Coy anaerobic chamber supplied with 90% $N_2$, 5% $CO_2$, and 5% $H_2$. Aliquots are collected at 0 hrs, 2 hrs, 4 hrs, 8 hrs and 24 hrs for single-chain antibody quantification.

Bacteria are then pelleted, washed, and harvested, resuspended in 25 mL sonication buffer (50 mM Tris-HCl, 30 mM NaCl, pH 8.0), and lysed by sonication on ice. Unsoluble debris is spun down twice for 20 min at 12,000 rpm at 4° C.

Recombinant anti-CTLA-4 and/or anti-PD-1 single-chain antibodies are purified using immobilized metal ion affinity chromatography. Protein concentration is determined by BCA protein assay, and isolated proteins are analyzed by Western blot. Proteins transferred onto PVDF membranes are detected with an HRP-conjugated anti-HIS6 antibody. To determine whether the single-chain antibody purified from *E. coli* Nissle functionally binds to the target protein, an ELISA assay is performed as described in Example 5.

Example 11. Engineering Bacterial Strains Using Chromosomal Insertions

Bacterial strains, in which the single chain antibody constructs are integrated directly into the *E. coli* Nissle genome under the control of an FNR-responsive promoter, are constructed.

To create a vector capable of integrating the PfnrS-single chain antibody construct into the chromosome at the Nissle lacZ locus, Gibson assembly is used to add 1000 bp sequences of DNA homologous to the Nissle lacZ locus to both sides of a flippase recombination target (FRT) site-flanked chloramphenicol resistance (cmR) cassette on a knock-in knock-out (KIKO) plasmid. Gibson assembly is then used to clone the PfnrS-single chain antibody construct DNA sequence between these homology arms, adjacent to the FRT-cmR-FRT site. Successful insertion of the fragment is validated by sequencing. PCR is used to amplify the entire lacZ::FRT-cmR-FRT:: PfnrS-single chain antibody construct::lacZ region. This knock-in PCR fragment is used to transform an electrocompetent Nissle strain that contains a temperature-sensitive plasmid encoding the lambda red recombinase genes. After transformation, cells are grown for 2 hrs at 37° C. Growth at 37° C. cures the temperature-sensitive plasmid. Transformants with successful chromosomal integration of the fragment are selected on chloramphenicol at 20 µg/mL.

To create a vector capable of integrating the PfnrS-single chain antibody construct into the *E. coli* Nissle chromosome at Nissle malP and malT loci, Gibson assembly is used to add 1000 bp sequences of DNA homologous to the Nissle malP and malT loci on either side of an FRT site-flanked kanamycin resistance (knR) cassette on a KIKO plasmid. Gibson assembly is then used to clone the PfnrS-single chain antibody DNA sequence between these homology arms, adjacent to the FRT-knR-FRT site. Successful insertion of the fragment is validated by sequencing. PCR is used to amplify the entire malP::FRT-knR-FRT:: PfnrS-single chain antibody construct::malT region. This knock-in PCR fragment is used to transform an electrocompetent Nissle strain already containing PfnrS-single chain antibody construct in the lacZ locus, and expressing the lambda red recombinase genes. After transformation, cells are grown for 2 hrs at 37° C. Transformants with successful integration of the fragment are selected on kanamycin at 50 µg/mL. These same methods may be used to create a vector capable of integrating the PfnrS-single chain antibody sequence at the malE/K insertion site.

In some embodiments, recombinase-based switches may be used to activate single chain antibody construct expression. To construct a strain allowing recombinase-based switches to regulate single chain antibody expression, the PfnrS-driven Int5 gene and the rrnBUP-driven, recombinase site-flanked single chain antibody sequences are synthesized by Genewiz (Cambridge, Mass.). Gibson assembly is used to add 1000 bp sequences of DNA homologous to the Nissle malP and malT loci on either side of the PfnrS-Int5, rrnBUP-single chain antibody DNA sequence and to clone this sequence between the homology arms. Successful insertion of the fragment into a KIKO plasmid is validated by sequencing. PCR is used to amplify the entire PfnrS-Int5, rrnBUP-single chain antibody region. This knock-in PCR fragment is used to transform an electrocompetent Nissle strain expressing the lambda red recombinase genes. After transformation, cells are grown for 2 hrs at 37° C. Transformants with successful integration of the PfnrS-single chain antibody fragment at the malPT intergenic region are selected on kanamycin at 50 μg/mL. This strategy may also be used to construct a recombinase-based strain requiring T7 polymerase activity for single chain antibody expression.

Example 12. Relative Efficacy of Chromosomal Insertion and Plasmid-Bearing Strains To compare the rate of functional single chain antibody expression degradation between engineered bacterial strains with chromosomal insertions and those harboring plasmids, overnight cultures are diluted 1:100 in LB and grown with shaking (250 rpm) at 37° C. After 1.5 hrs of growth, cultures are placed in a Coy anaerobic chamber supplying 90% N2, 5% CO2, 5% H2. After 4 hrs of induction, bacteria are pelleted, washed in PBS, and harvested, resuspended in 25 mL sonication buffer (50 mM Tris-HCl, 30 mM NaCl, pH 8.0), and lysed by sonication on ice. Unsoluble debris is spun down twice for 20 min at 12,000 rpm at 4° C.

Recombinant single chain antibodies are purified using immobilized metal ion affinity chromatography. Protein concentration is determined by BCA protein assay, and isolated proteins are analyzed by Western blot. Proteins transferred onto PVDF membranes are detected with an HRP-conjugated anti-HIS6 antibody. To determine whether the single-chain antibody purified from E. coli Nissle functionally binds to the target protein, an ELISA assay is performed as described in Example 5.

Example 13. Administration of E. coli Nissle Expressing Anti-CTLA-4 Antibody in a Mouse Syngeneic Tumor Model for Melanoma A mouse syngeneic tumor model is used to evaluate the anti-tumor efficacy of an anti-CTLA-4 single chain antibody. A suitable antibody for expression by the bacteria is an antibody which blocks murine CTL-A4, for example any of the sequences shown as 9H10, UC10-4F10-11, 9D9, and K4G4 in the tables herein. Bacteria expressing a human single chain anti-CTLA-4 antibody is prepared as described in Examples 1-5, 7-8, and 10-12.

Six to eight week old female C57BL/6 mice are implanted with s.c. tumors through the injection of $1\times10^6$ B 16F10 (melanoma) cells into the flank. Mice are monitored for tumor growth and when the tumors reach a volume of ~100 mm$^3$, the animals are randomized into different treatment groups. Treatment is initiated, in which animals are treated for 21-28 days. Mice are intratumorally administered either E. coli Nissle expressing the anti-CTLA-4 antibody, or the control bacteria (wild-type E. coli Nissle 1917). A control group is injected with the same volume of PBS. Intratumoral injections are performed 2 or 3 times weekly with different amounts of bacteria ranging from $1\times10^4$ to $1\times10^9$ bacteria suspended in 0.1 ml of PBS.

For benchmarking with systemic antibody treatment separate treatment groups are administered with a CTLA-4 antibody and a corresponding vehicle control within the same study. Control CTLA-4 antibody, and human immunoglobulin (hIgG) vehicle control are administered intraperitoneally, e.g., 100 m/mouse i.p. on the first day, 50 m/mouse on the third and fifth day (as described in Joseph F. Grosso and Maria N. Jure-Kunkel 2013 and Pedersen et al., 2006). A non-limiting suitable control antibody may be chosen from 9H10, UC10-4F10-11, 9D9, and K4G4.

Twice weekly, the animals are weighed, and tumor growth is assessed by measuring the size of the major and minor axes of s.c. tumors, using calipers and the tumor volume is calculated. Statistical significance is tested according to methods known in the art.

Animals are euthanized at the end of the study or when tumors reach 2000 mm3 (or before if it is deemed that tumors are adversely affecting animal health).

Additional syngeneic mouse models as described in Tables 67 and 68 are also tested.

Example 14. Administration of E. coli Nissle Expressing Human Anti-CTLA-4 Antibody in Humanized Mice Engrafted Subcutaneously with a Colon Carcinoma A humanized mouse model for colon carcinoma is used to evaluate the efficacy and potential side effects of bacterially delivered human single chain anti-CTLA-4 antibody. Bacteria expressing a human single chain anti-CTLA-4 antibody is prepared as described in Examples 1-5, 7-8, and 10-12.

Humanized CD34+ mice (NOD scid gamma mice engrafted with CD34+ cells through injection of CD34+ hematopoietic stem cells) are purchased from Jackson Labs (Pearson et al., 2008), bred, and maintained under specific pathogen-free conditions.

HCT-116 tumor cell lines are obtained from ATCC and cultured according to guidelines provided. Approximately 3×106 tumor cells are implanted on the flank of Humanized CD34+ mice. Animals are randomized based on tumor size on Day 7 post implantation and treatment is initiated.

For i.v. injection and intratumoral injection, bacteria are grown in LB broth until reaching an absorbance at 600 nm (A600 nm) of 0.4 (corresponding to 2×108 colony-forming units (CFU)/mL) and washed twice in PBS. The suspension is then diluted to so that 100 microL can be injected at the appropriate doses into the lateral tail vein or intratumorally into tumor-bearing mice. Bacteria suspended in 0.1 ml of PBS for injection. Vehicle control mice are injected with 0.1 mL PBS via tail vein.

For intratumoral administration, mice are administered either E. coli Nissle expressing a human single-chain anti-CTLA-4 antibody (e.g., ipilimumab sequence), or the control bacteria (wild-type E. coli Nissle 1917). A control group is injected with the same volume of PBS. Intratumoral injections are performed 2 or 3 times weekly with various doses of bacteria expressing ipilimumab or control bacteria, including the optimum dose determined as described above.

For intravenous administration, mice are intravenously administered either *E. coli* Nissle expressing the CTLA-4 antibody, or the control bacteria (wild-type *E. coli* Nissle 1917) through tail vein injection at doses ranging from $1\times10^5$ to $1\times10^9$. A control group is injected with the same volume of PBS.

In parallel, another treatment group is given a single dose of the indicated concentrations of ipilimumab or vehicle control (e.g., 200-500 m of ipilimumab or human immunoglobulin (hIg)) intraperitoneally every 4 days for a period of 40 days.

Tumors are measured two to three times per week until study termination. Tumor Volume is calculated (length ½ (width×width) 9×0.5)=volume in mm3.

Example 15. Rat Orthotopic Brain Tumor Model

Six-week-old female F344 Fisher rats (weight, 100 to 150 g) are anesthetized and luciferase transfected F98 glioma cells (2×104) are implanted through a burr hole into the right frontal lobe located 3 mm lateral and 2 mm anterior to the bregma. In vivo imaging is performed to determine tumor size via intraperitoneal injection of 8 mg of D-luciferin for each rat at day 12 after tumor cell implantation. Subsequently, $3\times10^6$ *E. coli* Nissle bacteria suspended in PBS, either wild type or genetically engineered to express anti-CTLA-4 antibody, are injected into the tumor. A control group is injected with the same volume of PBS. The rats are treated with intraperitoneal dexamethasone (10 mg/kg per day) for the first 2 days to minimize the risk of postoperative edema, similar to the standard clinical protocol used in human patients after brain tumor surgery and biopsy (Staedtke et al., 2015). If symptoms of distress occur, supportive therapy is provided for a 7-day period, after which dying animals are euthanized. The effectiveness of intratumorally injected *E. coli* Nissle expressing the CTLA-4 antibody as compared to the wild type strain is evaluated by Kaplan-Meier survival curves. Brains are collected post mortem, placed in formalhyde, and embedded in paraffin for additional pathological studies and to determine the differences in tumor burden between the groups. Gram-stained slides, counterstained with safranin, and hematoxylin and eosin (H&E) slides are obtained by methods known in the art.

Example 16. Evaluation of Anti-Tumor Efficacy with Bacteria Engineered to Express a CTLA-4 Antibody and a PD-1 Antibody in a Mouse Syngeneic Tumor Model for Lung Cancer Six to eight week old female C57BL/6 mice are implanted with s.c. tumors through the injection of $1\times10^6$ LL2 (lung cancer) cells into the flank. Mice are monitored for tumor growth and when the tumors reach a volume of ~100 mm3, the animals are randomized into different treatment groups. Treatment is initiated, and mice are intratumorally administered either *Clostridium novyi*-NT expressing the CTLA-4 antibody, or the control bacteria (wild-type *Clostridium novyi*-NT) for 21-28 days at various doses. A control group is injected with the same volume of PBS. Intratumoral injections are performed 2 to 3 times weekly. *Clostridium novyi*-NT spores are suspended in 0.1 ml of PBS with various bacterial doses (ranging from $1\times10^4$ to $1\times10^7$. For benchmarking against systemic antibody delivery, a concurrent administration of CTLA-4 antibody and PD-1 antibody is performed in a separate treatment group. A corresponding human IgG control is administered in parallel. CTLA4 and PD-1 antibodies and human immunoglobulin (hIgG) vehicle control are administered intraperitoneally, for example, as described in Duraiswamy et al., 2013 (Cancer Res. 2013 Jun. 15; 73(12): 3591-3603. Dual Blockade of PD-1 and CTLA-4 Combined with Tumor Vaccine Effectively Restores T Cell Rejection Function in Tumors). Suitable anti-PD-1 antibodies include heavy and light chain sequence based on RMP14 and J43 with can be used to make a single chain antibody sequence. Suitable CTLA-4 antibodies include heavy and light sequences based on sequences shown herein which can be use to make a single-chain antibody sequence.

Twice weekly, the animals are weighed, and tumor growth is assessed by measuring the size of the major and minor axes of s.c. tumors, using calipers and the tumor volume is calculated. Statistical significance is tested according to methods known in the art.

Animals are euthanized at the end of the study or when tumors reach 2000 mm3 (or before if it is deemed that tumors are adversely affecting animal health).

Example 17. Evaluation of Anti-Tumor Efficacy Using Bacteria Engineered to Express Kynureninase and Anti-CTLA-4 Antibody in a Breast Cancer Model Six to eight week old female Balb/c mice are implanted with 4T1 s.c. tumors as described above. Treatment is initiated, and mice are intratumorally administered either *E. coli* Nissle engineered to express anti-CTLA-4 antibody and kynureninase, or the control bacteria (*E. coli* Nissle 1917) 2 to 3 times a week at the appropriate dose determined above for 21-28 days. A control group is injected with the same volume of PBS. Intratumoral injections are performed as described above. For benchmarking against systemic delivery, a concurrent administration of anti-CTLA-4 antibody and IDO inhibitor (e.g., indoximod) is performed in a separate treatment group. A corresponding human IgG control is administered in parallel. Anti-CTLA4 antibody, human immunoglobulin (hIgG) vehicle control and IDO inhibitor are administered intraperitoneally.

As described above, the animals are weighed, and tumor growth is assessed. Statistical significance is tested according to methods known in the art.

Animals are euthanized at the end of the study or when tumors reach 2000 mm3 (or before if it is deemed that tumors are adversely affecting animal health).

Example 18. Oral Administration of Bacteria Engineered to Express Anti-CTLA-4 Antibody and IL-12 in the Treatment of Liver Metastases The liver metastasis model is generated by injecting mouse cancer cells (MC26 and 393M1 in parallel) into surgically externalized spleens of immunocompetent mice. After 90 s, to allow tumor cells to seed the liver, the spleen is removed to prevent ectopic tumor growth. MC26 cells are injected at 5×104 cells per 100 ml of PBS into the spleens of female Balb/c mice 6 weeks of age, and 393M1 cells are injected at 1×105 cells per 100 ml of PBS into female B6.129SF1/J mice 6 weeks of age and animals and treatment is initiated when the tumors reach a size of 100 mm$^3$.

*E. coli* Nissle engineered to express anti-CTLA-4 antibody and IL-2, and the control bacteria (wild type *E. coli* Nissle 1917) are prepared by growth in LB until exponential phase, washed three times with sterile PBS, and then diluted in sterile PBS. Mice are gavaged with $5\times10^9$ CFU bacteria, as described in Danino et al., 2015.

Twice weekly, the animals are weighed, and tumor growth is assessed by measuring the size of the major and minor axes of s.c. tumors, using calipers and the tumor volume is calculated. Statistical significance is tested according to methods known in the art.

Example 19. Administration of C. novyi Expressing Human Anti-PD-1 Antibody, IL-15, and Kynureninase (Depleting Kynurenine) in Humanized Mice as a Model for Colon Cancer Humanized CD34+ mice (NOD scid gamma mice engrafted with CD34+ cells through injection of CD34+ hematopoietic stem cells) are purchased from Jackson Labs (Pearson et al., 2008), bred, and maintained under specific pathogen-free conditions.

HT-29 cell line is obtained from ATCC and cultured according to the guidelines provided. Approximately $3\times10^6$ tumor cells are implanted on the flank of Humanized CD34+ mice. Animals are randomized based on tumor size and treatment is initiated when tumors reach 100 mm$^3$.

For i.v. injection and intratumoral injection, bacteria are grown in LB broth until reaching an absorbance at 600 nm (A600 nm) of 0.4 (corresponding to $2\times10^8$ colony-forming units (CFU)/mL) and washed twice in PBS. The suspension is then diluted to so that 100 microL can be injected at the appropriate doses into the lateral tail vein or intratumorally into tumor-bearing mice. Bacterial spores are suspended in 0.1 ml of PBS for injection. Vehicle control mice are injected with 0.1 mL PBS via tail vein.

For intratumoral administration, mice are administered either C. novyi expressing human anti-PD-1 antibody, IL-15, and kynureninase, or the control bacterial spores (wild-type C. novyi). A control group is injected with the same volume of PBS. Intratumoral injections are performed 2 to 3 times weekly with various doses of bacteria expressing a anti-human PD-1 antibody or control bacteria, including the optimum dose determined as described above.

For intravenous administration, mice are intravenously administered either C. novyi expressing human anti-PD-1 antibody, IL-15, and kynureninase, or the control bacteria (wild-type C. novyi) through tail vein injection at doses ranging from $1\times10^5$ to $1\times10^8$. A control group is injected with the same volume of PBS.

For oral administration, mice are gavaged with $5\times10^9$ CFU bacteria, either C. novyi expressing human anti-PD-1 antibody, IL-15, and kynureninase, or the control bacteria (wild-type C. novyi), as described in Danino et al., 2015.

Tumors are measured two to three times per week until study termination. Tumor Volume is calculated (length 9 (width 9 width) 9 0.5)=volume in mm$^3$.

Example 20 Administration of E. coli Nissle Expressing Human Anti-CTLA-4 Antibody, IL-12, and Capable of Producing Tryptophan in a Humanized Mouse Tumor Model for Breast Cancer Humanized CD34+ mice (NOD scid gamma mice engrafted with CD34+ cells through injection of CD34+ hematopoietic stem cells) are purchased from Jackson Labs (Pearson et al., 2008), bred, and maintained under specific pathogen-free conditions.

EMT-6 (breast cancer derived) cell line is obtained from ATCC and cultured according to guidelines provided. Approximately $3\times10^6$ tumor cells are implanted on the flank of humanized CD34+ mice. When the tumor reaches 100 mm3, animals are randomized and treatment is initiated.

For i.v. injection and intratumoral injection, bacteria are grown in LB broth until reaching an absorbance at 600 nm (A600 nm) of 0.4 (corresponding to $2\times10^8$ colony-forming units (CFU)/mL) and washed twice in PBS. The suspension is then diluted to so that 100 microL can be injected at the appropriate doses into the lateral tail vein or intratumorally into tumor-bearing mice. Bacteria suspended in 0.1 ml of PBS for injection. Vehicle control mice are injected with 0.1 mL PBS via tail vein.

For oral administration, bacteria are prepared by growth in LB until exponential phase, washed three times with sterile PBS, and then diluted to the appropriate concentration in sterile PBS.

For intratumoral administration, mice are administered either E. coli nissle expressing human anti-CTLA-4 antibody, IL-12, and a tryptophan cassette for the production of tryptophan or the control bacteria (wild-type E. coli nissle). A control group is injected with the same volume of PBS. Intratumoral injections are performed 2 to 3 times weekly with various doses of bacteria expressing ipilimumab or control bacteria, including the optimum dose determined as described above.

For intravenous administration, mice are intravenously administered either E. coli nissle expressing human anti-CTLA-4 antibody, IL-12, and a tryptophan cassette for the production of tryptophan or the control bacteria (wild-type E. coli nissle) through tail vein injection at doses ranging from $1\times10^5$ to $1\times10^9$. A control group is injected with the same volume of PBS.

For oral administration, mice are gavaged with $5\times10^9$ CFU E. coli nissle expressing human anti-CTLA-4 antibody, IL-12, and a tryptophan cassette for the production of tryptophan or the control bacteria (wild-type E. coli nissle), as described in Danino et al., 2015

Tumors are measured two to three times per week until study termination. Tumor volume is calculated (length 9 (width 9 width) 9 0.5)=volume in mm$^3$.

Example 21 Administration of E. coli Nissle Expressing Human Anti-CTLA-4 Antibody, IL-12, and Capable of Producing Arginine (Depleting Arginasel) in a Humanized Mouse Tumor Model for Breast Cancer Humanized CD34+ mice (NOD scid gamma mice engrafted with CD34+ cells through injection of CD34+ hematopoietic stem cells) are purchased from Jackson Labs (Pearson et al., 2008), bred, and maintained under specific pathogen-free conditions.

EMT-6 (breast cancer derived) cell line is obtained from ATCC and cultured according to guidelines provided. Approximately $3\times10^6$ tumor cells are implanted on the flank of humanized CD34+ mice. When the tumor reaches 100 mm3, animals are randomized and treatment is initiated.

For i.v. injection and intratumoral injection, bacteria are grown in LB broth until reaching an absorbance at 600 nm (A600 nm) of 0.4 (corresponding to $2\times10^8$ colony-forming units (CFU)/mL) and washed twice in PBS. The suspension is then diluted to so that 100 microL can be injected at the appropriate doses into the lateral tail vein or intratumorally into tumor-bearing mice. Bacteria suspended in 0.1 ml of PBS for injection. Vehicle control mice are injected with 0.1 mL PBS via tail vein.

For oral administration, bacteria are prepared by growth in LB until exponential phase, washed three times with sterile PBS, and then diluted to the appropriate concentration in sterile PBS.

For intratumoral administration, mice are administered either E. coli nissle expressing human anti-CTLA-4 antibody, IL-12, and a cassette for the production of arginine or the control bacteria (wild-type E. coli nissle). A control group is injected with the same volume of PBS. Intratumoral injections are performed 2 to 3 times weekly with various doses of bacteria expressing ipilimumab or control bacteria, including the optimum dose determined as described above.

For intravenous administration, mice are intravenously administered either E. coli nissle expressing human anti-CTLA-4 antibody, IL-12, and a tryptophan cassette for the production of tryptophan or the control bacteria (wild-type E. coli nissle) through tail vein injection at doses ranging from $1 \times 10^5$ to $1 \times 10^9$. A control group is injected with the same volume of PBS.

For oral administration, mice are gavaged with $5 \times 10^9$ CFU E. coli nissle expressing human anti-CTLA-4 antibody, IL-12, and a tryptophan cassette for the production of tryptophan or the control bacteria (wild-type E. coli nissle), as described in Danino et al., 2015

Tumors are measured two to three times per week until study termination. Tumor volume is calculated (length 9 (width 9 width) 9 0.5)=volume in $mm^3$.

Example 22. Administration of E. coli K12 Expressing Anti-PDL-1 Antibody in a Mouse Syngeneic Tumor Model for Pancreatic Carcinoma To evaluate the anti-tumor efficacy and potential side effects of administration of genetically engineered bacteria expressing an anti-PDL-1 antibody and to determine the optimum dose, a mouse syngeneic tumor model is used. A suitable antibody for expression by the bacteria is an antbody, which blocks murine PDL-1, e.g., a single chain PD-L1 antibody.

Six to eight week old female Balb/c mice are implanted with s.c. tumors through the injection of $1 \times 10^6$ Pan02 (pancreatic carcinoma) cells into the flank. Mice are monitored for tumor growth and when the tumors reach a volume of ~100 $mm^3$, the animals are randomized into different treatment groups. Treatment is initiated, in which animals are treated for 21-28 days. Mice are intratumorally administered either E. coli K12 expressing the PD-L1 antibody, or the control bacteria (wild-type E. coli K12). A control group is injected with the same volume of PBS. Intratumoral injections are performed 2 or 3 times weekly with different amounts of bacteria ranging from $1 \times 10^4$ to $1 \times 10^9$ bacteria suspended in 0.1 ml of PBS.

For benchmarking with systemic antibody treatment separate treatment groups are administered with a PD-L1 antibody and a corresponding vehicle control within the same study. Control PD-L1 antibody, and human immunoglobulin (hIgG) vehicle control are administered intraperitoneally, e.g., 100 m/mouse i.p. on the first day, 50 m/mouse on the third and fifth day (as described in Joseph F. Grosso and Maria N. Jure-Kunkel 2013 and Pedersen et al., 2006). A non-limiting suitable control antibody may be chosen from 9H10, UC10-4F10-11, 9D9, and K4G4.

Twice weekly, the animals are weighed, and tumor growth is assessed by measuring the size of the major and minor axes of s.c. tumors, using calipers and the tumor volume is calculated. Statistical significance is tested according to methods known in the art.

Animals are euthanized at the end of the study or when tumors reach 2000 mm3 (or before if it is deemed that tumors are adversely affecting animal health).

Additional syngeneic mouse models as described in the above tables are also tested.

Example 23. Administration of Lactobacillus casei Expressing Anti-CTLA-4 Antibody in a Mouse Syngeneic Tumor Model for Colon Carcinoma To evaluate the anti-tumor efficacy and potential side effects of administration of genetically engineered bacteria expressing an anti-CTL-A4 antibody and to determine the optimum dose, a mouse syngeneic tumor model is used. A suitable antibody for expression by the bacteria is an antibody that blocks murine CTL-A4, including but not limited to, 9H10, UC10-4F10-11, 9D9, and K4G4 (as described in Table 67). Single chain antibodies can be made using the heavy and light chain sequences provided herein for said antibodies.

Six to eight week old female Balb/c mice are implanted with s.c. tumors through the injection of $1 \times 10^6$ MBT2 (carcinogen-induced, undifferentiated colon carcinoma) cells into the flank. Mice are monitored for tumor growth and when the tumors reach a volume of ~100 $mm^3$, the animals are randomized into different treatment groups. Treatment is initiated, in which animals are treated for 21-28 days. Mice are intratumorally administered either Lactobacillus casei expressing the CTLA-4 antibody, or the control bacteria (wild-type Lactobacillus casei). A control group is injected with the same volume of PBS. Intratumoral injections are performed 2 or 3 times weekly with different amounts of bacteria ranging from $1\ 10^4$ to $1 \times 10^7$ bacteria suspended in 0.1 ml of PBS.

For benchmarking with systemic antibody treatment separate treatment groups are administered with a CTLA-4 antibody and a corresponding vehicle control within the same study. Control CTLA-4 antibody, and human immunoglobulin (hIgG) vehicle control are administered intraperitoneally, e.g., 100 m/mouse i.p. on the first day, 50 m/mouse on the third and fifth day (as described in Joseph F. Grosso and Maria N. Jure-Kunkel 2013 and Pedersen et al., 2006). A non-limiting suitable control antibody may be chosen from 9H10, UC10-4F10-11, 9D9, and K4G4.

Twice weekly, the animals are weighed, and tumor growth is assessed by measuring the size of the major and minor axes of s.c. tumors, using calipers and the tumor volume is calculated. Statistical significance is tested according to methods known in the art.

Animals are euthanized at the end of the study or when tumors reach 2000 mm3 (or before if it is deemed that tumors are adversely affecting animal health).

Additional syngeneic mouse models as described in Tables 67 and 68 are also tested.

Example 24. Genetically Engineered HSV-Based OV Expressing IL-15 or Anti-PD-1 Antibody for Immunotherapy A syngeneic mouse model is used to assess a tumor-specific cell-mediated immune response generated by a genetically engineered OV upon intratumoral injection of the OV as compared to the OV control, a syngeneic mouse model is used. In vitro toxicity assays are also conducted.

Genetically engineered HSV-1 virus having ICP6 and γ134.5 deletions and expressing a IL-15 or anti-PD-1 antibody are tested for anti-tumor activity.

A. Cytotoxicity Assays

OVs are grown and titered according to methods described in the art. For cytotoxicity assays, human colon cancer-derived cells (CT-26) are seeded at approximately $1\times10^4$ cells per well in a 96-well dish and grown in complete medium. Twenty-four hours later, cells are infected with the genetically engineered HSV-1 OV and the corresponding OV control (no IL-15 or anti-PD-1 antibody) at various concentrations, e.g., between $1\times10^2$ and $1\times10^9$. Cell viability is determined by fluorometric method using CellTiter-Fluor Cell Viability Assay according to manufacturer's instruction daily over a time period of 2 weeks.

B. Syngeneic Mouse Model for IL-15 Expressing OV

MC-38 colon carcinoma cell line is obtained from ATCC and cultured according to guidelines provided. Approximately 3×106 tumor cells are implanted on the flank of C57Bl/6. When the tumor reaches 100 mm3, animals are randomized into groups as follows and treatments are initiated. Treatment groups are as follows: various doses of genetically engineered OV expressing IL-15 (e.g., ranging between $1\times10^6$ and $1\times10^8$) for intratumoral delivery; OV HSV-1 control for intratumoral delivery; PBS only for intratumoral delivery; and systemic injection of IL-15) and treatment is initiated. The genetically engineered OV is administered in a regimen of multiple cycles, e.g., of three intratumoral injections three days apart. For comparison systemic injection of an IL-15 is conducted in parallel. Tumor growth inhibition/tumor regressions of tumors and survival is monitored. Additionally, to determine the extent of inflammation, tumor infiltrating lymphocytes are separated from tumor cells according to methods described in the art, and interferon gamma production is determined by capture ELISA following splenocyte T cell stimulation with ionomycin and LPS (e.g., as described in Mathios et al., Int J Cancer. 2016 Jan. 1; 138(1):187-94; Therapeutic administration of IL-15 superagonist complex ALT-803 leads to long-term survival and durable antitumor immune response in a murine glioblastoma model).

C. Syngeneic Mouse Model for Anti-PD-1 Antibody Expressing OV

MC-38 colon carcinoma cell line is obtained from ATCC and cultured according to guidelines provided. Approximately 3×106 tumor cells are implanted on the flank of C57Bl/6. When the tumor reaches 100 mm3, animals are randomized into groups as follows and treatments are initiated. Treatment groups are as follows: various doses of genetically engineered OV expressing anti-PD-1 antibody (e.g., ranging between $1\times10^6$ and $1\times10^8$) for intratumoral delivery; OV HSV-1 control for intratumoral delivery; PBS only for intratumoral delivery; and systemic injection of anti-PD-1 antibody) and treatment is initiated.

The genetically engineered OV is administered in a regimen of multiple cycles, e.g., of three intratumoral injections three days apart. For comparison systemic injection of an anti-PD-1 antibody is conducted in parallel. Tumor growth inhibition/tumor regressions of tumors and survival is monitored. Additionally, to determine the extent of inflammation, tumor infiltrating lymphocytes are separated from tumor cells according to methods described in the art, and interferon gamma production is determined by capture ELISA following splenocyte T cell stimulation with ionomycin and LPS (e.g., as described in Mathios et al., 2016).

D. Combination of Il-15 and Anti-PD-1 Antibody

Different ratios of a mixture of genetically engineered OV expressing anti-PD-1 and genetically engineered OV expressing IL-15 are evaluated in the system as described in A and B.

Example 25. Generation of Adenosine Degrading Strains

A schematic representation of the 3 operons in the adenosine degradation pathway is shown in FIGS. 4A and 4B. To generate Adenosine consuming strains, each one of the operons (or single gene in the case of nupC) were cloned into a KIKO vector under the control of the $P_{fnrs}$ promoter. Knock-in PCR products were made from the KIKO vectors and allelic exchange was performed to integrate these operons into *E. coli* genome. Allelic exchange was facilitated through use of the lambda red recombinase system as described herein. Multiple strain combinations were generated and Table 76. summarizes the strains generated and compared in adenosine degradation assays. Table 77. summarizes the integration sites that were used for each of the constructs. Table 78. Summarizes sequences of the constructs.

TABLE 76

Adenosine consuming strains

| Strain: | Genotype |
|---|---|
| SYN01 | WT |
| SYN1565 | $P_{fnrS}$-nupC |
| SYN1584 | $P_{fnrS}$-nupC; $P_{fnrS}$-xdhABC |
| SYN1655 | $P_{fnrS}$-nupC; $P_{fnrS}$-add-xapA-deoD |
| SYN1656 | $P_{fnrS}$-nupC; $P_{fnrS}$-xdhABC; $P_{fnrS}$-add-xapA-deoD |

TABLE 77

Integration sites (can also see strain table)

| Construct | Chromosomal Integration Site |
|---|---|
| $P_{fnrS}$-nupC | integrated into HA1/2 (*agaI/rsmI*) region |
| $P_{fnrS}$-xdhABC | integrated into HA9/10 (*exo/cea*) region |
| $P_{fnrS}$-add-xapA-deoD | integrated into *malE/K* region |

TABLE 78

Sequences

| Description/ SEQ ID NO | Sequence |
|---|---|
| PfnrS (RBS underlined; FNR binding site underlined and italics) SEQ ID NO: 856 | GGTACCAGTTGTTCTTATTGGTGGTGTTGCTTTATGGTTGCATCGTAG TAAATGGTTGTAACAAAAGCAATTTTTCCGGCTGTCTGTATACAAAA ACGCCGTAAAGT*TTGAGCGAAGTCAATAAACTCTCTACCC*ATTCAGGGCA *ATATCTCTCTTGGATCC*AAAGTGAACTCTAGAAATAATTTTGTTTAACT TTAAGAAGGAGATATACAT |

TABLE 78-continued

Sequences

| Description/ SEQ ID NO | Sequence |
| --- | --- |
| P<sub>fnrS</sub>-nupC (nupC underlined) SEQ ID NO: 857 | GGTACCAGTTGTTCTTATTGGTGGTGTTGCTTTATGGTTGCATCGTAG<br>TAAATGGTTGTAACAAAAGCAATTTTTCCGGCTGTCTGTATACAAAA<br>ACGCCGTAAAGTTTGAGCGAAGTCAATAAACTCTCTACCCATTCAGG<br>GCAATATCTCTCTTGGATCCAAAGTGAACTCTAGAAATAATTTTGTTT<br>AACTTTAAGAAGGAGATATACATGTGCACGGAAATTTAACCTGCCTC<br>ATATTTGGAGCAAATATGGACCGCGTCCTTCATTTTGTACTGGCACTT<br>GCCGTTGTTGCGATTCTCGCACTGCTGGTAAGCAGCGACCGCAAAAA<br>AATTCGTATCCGTTATGTTATTCAACTGCTTGTTATCGAAGTGTTACT<br>GGCGTGGTTCTTCCTGAACTCCGACGTTGGTCTGGGCTTCGTGAAAG<br>GCTTCTCCGAAATGTTCGAAAAACTGCTCGGTTTTGCCAACGAAGGG<br>ACTAACTTCGTCTTTGGTAGCATGAATGATCAAGGCCTGGCATTCTTC<br>TTCCTGAAAGTGCTGTGCCCAATCGTCTTTATCTCTGCGCTGATCGGT<br>ATTCTCCAGCATATTCGCGTATTGCCGGTGATTATCCGCGCAATTGGT<br>TTCCTGCTCTCCAAAGTCAACGGCATGGGCAAACTGGAATCCTTTAA<br>CGCCGTCAGCTCCCTGATTCTGGGTCAGTCTGAAAACTTTATTGCCTA<br>TAAAGATATCCTCGGCAAAATCTCCCGCAATCGTATGTACACCATGG<br>CAGCAACGGCGATGTCCACCGTGTCGATGTCCATCGTTGGTGCATAT<br>ATGACCATGCTGGAGCCGAAATACGTCGTTGCGGCGCTGGTACTGAA<br>CATGTTCAGCACCTTTATCGTGCTGTCGCTGATCAACCCCTTACCGTGT<br>TGATGCCAGTGAAGAAAACATTCAGATGTCCAACCTGCACGAAGGTC<br>AGAGCTTCTTCGAAATGCTGGGTGAATACATTCTGGCAGGTTTCAAA<br>GTTGCCATTATCGTTGCCGCGATGCTGATCGGCTTTATCGCCCTGATC<br>GCTGCACTGAACGCTCTGTTTGCTACCGTGACTGGCTGGTTTGGCTAC<br>AGCATCTCCTTCCAGGGCATCCTGGGTTACATCTTCTATCCGATTGCA<br>TGGGTGATGGGTGTTCCTTCCAGTGAAGCACTGCAAGTGGGCAGTAT<br>CATGGCGACCAAACTGGTTTCCAACGAGTTCGTTGCGATGATGGATC<br>TGCAGAAAATTGCTTCCACGCTCTCTCCGCGTGCGGAAGGCATCATC<br>TCTGTGTTCCTGGTTTCCTTCGCTAACTTCTCTTCAATCGGGATTATCG<br>CGGGTGCGGTTAAAGGCCTGAATGAAGAGCAAGGTAACGTGGTTTCT<br>CGCTTCGGTCTGAAACTGGTTTACGGCTCTACCCTGGTGAGTGTGCTG<br>TCTGCGTCAATCGCAGCACTGGTGCTGTAA |
| P<sub>fnrS</sub>-xdhABC SEQ ID NO: 858 | GGTACCAGTTGTTCTTATTGGTGGTGTTGCTTTATGGTTGCATCGTAG<br>TAAATGGTTGTAACAAAAGCAATTTTTCCGGCTGTCTGTATACAAAA<br>ACGCCGTAAAGTTTGAGCGAAGTCAATAAACTCTCTACCCATTCAGG<br>GCAATATCTCTCTTGGATCCAAAGTGAACTCTAGAAATAATTTTGTTT<br>AACTTTAAGAAGGAGATATACATATGCGCGTCGATGCCATTGCTAAG<br>GTCACCGGGCGGGCACGATATACTGACGATTATATTATGGCGGGCAT<br>GTGTTACGCGAAATATGTACGTAGCCCTATCGCACATGGTTATGCTGT<br>AAATATTAATGATGAACAAGCCAGGAGTTTGCCGGGCGTCCTGGCGA<br>TTTTTACCTGGGAAGATGTGCCAGAAATCCCATTCGCCACGGCAGGG<br>CATGCCTGGACACTTGACGAAAACAAGCGCGATACCGCCGATCGTGC<br>CCTGCTAACGCGTCATGTTCGTCATCATGGTGACGCCGTTGCCATCGT<br>CGTGGCCCGCGATGAACTCACGGCAGAAAAAGCGGCGCAATTGGTC<br>AGCATTGAGTGGCAAGAATTACCCGTTATCACCTCGCCAGAAGCGGC<br>GCTGGCAGAAGACGCTGCACCAATCCATAACGGTGGCAATTTACTGA<br>AACAAAGCACGATGTCGACGGGTAATGTCCAACAAACAATCGATGC<br>CGCCGACTACCAGGTACAGGGGCACTATCAGACTCCCGTTATTCAAC<br>ATTGTCATATGGAAAGCGTGACATCGCTGGCATGGATGAGGATGAC<br>TCGCGAATTACCATCGTTTCCAGCACCCAGATCCCGCACATTGTTCGC<br>CGCGTGGTTGGTCAGGCGCTGGATATTCCCTGGTCATGCGTACGAGT<br>CATCAAACCGTTTATCGGTGGCGGTTTTGGTAATAAACAGGATGTAC<br>TGGAAGAGCCAATGGCGGCATTCCTGACCAGCAAACTTGGCGGCATT<br>CCGGTGAAAGTTTCCCTTAGCCGTGAAGAGTGTTTCCTCGCAACCCGT<br>ACCCGCCACGCTTTTACTATTGACGGGCAAATGGGCGTGAACCGCGA<br>CGGAACATTGAAAGGTTATAGTCTGGATGTTCTGTCTAACACCGGCG<br>CTTATGCATCTCACGGGCACTCCATTGCTTCTGCTGGGGGGAATAAA<br>GTCGCTTACCTTTATCCTCGTTGTGCCTACGCTTACAGTTCAAAGACC<br>TGCTATACCAACCTCCCCTCGGCTGGTGCGATGCGTGGTTATGGCGC<br>GCCACAAGTCGTATTTGCCGTTGAGTCTATGCTTGATGATGCCGCGAC<br>AGCGTTAGGTATTGATCCTGTTGAAATTCGTTTACGCAACGCCGCCCG<br>CGAAGGAGATGCTAATCCGCTCACGGGAAAACGTATTTACAGCGCAG<br>GGTTGCCGGAGTGTCTTGAAAAAGGCCGGAAAATCTTTGAATGGGAA<br>AAACGCCGTGCAGAGTGCCAGAACCAGCAAGGCAATTTACGTCGTG<br>GCGTTGGCGTCGCCTGTTTTAGCTACACCTCTAACACCTGGCCTGTCG<br>GCGTAGAAATAGCAGGCGCGCGCCTGTTGATGAATCAGGATGGAAC<br>CATCAACGTGCAAAGCGGCGCGACGGAAATCGGCCAGGGTGCCGAC<br>ACCGTGTTCTCGCAAATGGTGGCAGAAACCGTGGGAGTTCCGGTCAG<br>CGATGTTCACGTTATTTCAACCCAAGATACCGACGTTACACCATTCGA<br>CCCCGGCGCATTTGCCTCACGTCAGAGCTATGTTGCCGCGCCTGCGCT<br>GCGCAGTGCAGCACTGTTATTAAAGAGAAAATCATCGCTCACGCCG<br>CAGTCATGCTACATCAGTCAGCGATGAATCTGACCCTGATAAAAGGC<br>CATATCGTGCTGATTGAAAGACCGGAAGAACCGTTAATGTCGTTAAA |

TABLE 78-continued

Sequences

| Description/ SEQ ID NO | Sequence |
|---|---|
| | AGATTTGGCGATGGACGCTTTCTACCACCCTGAACGCGGCGGGCAGC<br>TCTCTGCCGAAAGCTCCATCAAAACCACCACTAACCCACCGGCGTTT<br>GGCTGTACCTTTGTTGATCTGACGGTCGATATTGCACTGTGCAAAGTC<br>ACCATCAACCGCATCCTCAACGTTCATGATTCGGGCCATATTCTTAAT<br>CCGCTGCTGGCAGAAGGTCAGGTACACGGCGGAATGGGAATGGGCA<br>TTGGCTGGGCGCTATTTGAAGAGATGATCATCGATGCGAAAAGCGGC<br>GTGGTCCGTAACCCCAATCTGCTGGATTACAAAATGCCGACCATGCC<br>GGATCTGCCACAACTGGAAAGCGCGTTCGTCGAAATCAATGAGCCGC<br>AATCAGCATACGGACATAAGTCACTGGGTGAGCCCCCCATAATTCCT<br>GTAGCCGCTGCTATTCGTAACGCGGTGAAGATGGCTACCGGTGTTGC<br>AATCAATACACTGCCGCTAACGCCAAAACGATTATATGAAGAATTCC<br>ATCTGGCAGGATTGATTTGAGGATAACATCATGTTTGATTTTGCTTCT<br>TACCATCGCGCAACCACCCTTGCCGATGCCATCACCCTGCTGGCTGA<br>CAATCCGCAGGCCAAATTGCTTGCCGGTGGCACTGACGTACTGATAC<br>AGCTTCACCATCACAATGACCGCTATCGCCATATTGTTGATATCCACA<br>ATCTGGCAGAGCTTCAGGGAATAACACAGGCGGAAGATGGCGCGCT<br>GCGAATCGGCTCTGCGACAACATTTACTCAGCTCATTGAAGATCCCG<br>TAATCCAACGCAATCTCCCGGCGTTATGTGCTGCGGCTGCATCAATC<br>GCCGGGCCGCAGATCCGTAATGTCGCCACCTACGGCGGAAATATTTG<br>CAACGGTGCCACCAGCGCAGATTCTGCCACGCCAACGCTAATTTATG<br>ACGCGAAACTGGAGCTCCACTCCCCACGCGGTGTTCGTTTCGTCCCG<br>ATTAATGGCTTTCACACCGGGCCGGGCAAAGTGTCTCTTGAGCATGA<br>CGAAATCCTTGTCGCCTTTCATTTTCCGCCACAGCCGAAAGAACACG<br>CGGGCAGCGCGCATTTTAAATATGCCATGCGCGACGCAATGGATATT<br>TCAACAATTGGCTGCGCCGCACATTGCCGACTGGATAACGGCAATTT<br>CAGCGAATTACGCCTGGCATTTGGTGTTGCCGCGCCAACGCCGATTC<br>GCTGCCAACATGCCGAACAGACTGCACAAAATGCGCCATTAAACCTG<br>CAAACGCTGGAAGCCATCAGCGAATCAGTCCTGCAAGATGTCGCCCC<br>GCGTTCTTCATGGCGGGCCAGTAAAGAGTTTCGTCTGCATCTCATCCA<br>GACGATGACCAAAAAGTGATTAGCGAAGCCGTCGCCGCGGCGGGG<br>GGAAAATTGCAATGAATCACAGCGAAACAATTACCATCGAATGCACC<br>ATTAACGGGATGCCTTTTCAGCTTCACGCCGCGCCAGGAATGCCGCT<br>TTCGGAACTACTCCGAGAACAAGGGCTTCTTAGTGTCAAACAAGGTT<br>GCTGCGTAGGCGAATGCGGTGCCTGTACGGTGCTGGTCGACGGCACT<br>GCGATAGACAGTTGCTTATTCCTTGCGACCTGGGCTGAAGGAAAAGA<br>GATCCGCACGCTGGAAGGTGAAGCGAAAGGCGGTAAACTTTTCTCATG<br>TCCAACTGGCTTATGCGAAATCTGGTGCAGTGCAATGCGGGTTTTGT<br>ACGCCGGGCCTGATTATGGCTACCACGGCGATGCTGGCAAAACCACG<br>CGAAAAACCATTAACCATTACGGAAATTCGTCGTGGACTGGCGGGAA<br>ATCTTTGTCGCTGCACGGGGTATCAGATGATTGTAAATACAGTTCTGG<br>ATTGCGAGAAAACGAAGTAA |
| xdhABC SEQ ID NO: 859 | ATGCGCGTCGATGCCATTGCTAAGGTCACCGGGCGGGCACGATATAC<br>TGACGATTATATTATGGCGGGCATGTGTTACGCGAAATATGTACGTA<br>GCCCTATCGCACATGGTTATGCTGTAAATATTAATGATGAACAAGCC<br>AGGAGTTTGCCGGGCGTCCTGGCGATTTTTACCTGGGAAGATGTGCC<br>AGAAATCCCATTCGCCACGGCAGGGCATGCCTGGACACTTGACGAAA<br>ACAAGCGCGATACCGCCGATCGTGCCCTGCTAACGCGTCATGTTCGT<br>CATCATGGTGACGCCGTTGCCATCGTCGTGGCCCGCGATGAACTCAC<br>GGCAGAAAAGCGGCGCAATTGGTCAGCATTGAGTGGCAAGAATTA<br>CCCGTTATCACCTCGCCAGAAGCGGCGCTGGCAGAAGACGCTGCACC<br>AATCCATAACGGTGGCAATTTACTGAAACAAAGCACGATGTCGACGG<br>GTAATGTCCAACAAACAATCGATGCCGCCGACTACCAGGTACAGGGG<br>CACTATCAGACTCCCGTTATTCAACATTGTCATATGGAAAGCGTGAC<br>ATCGCTGGCATGGATGGAGGATGACTCGCGAATTACCATCGTTTCCA<br>GCACCCAGATCCCGCACATTGTTCGCCGCGTGGTTGGTCAGGCGCTG<br>GATATTCCCTGGTCATGCGTACGAGTCATCAAACCGTTTATCGGTGGC<br>GGTTTTGGTAATAAACAGGATGTACTGGAAGAGCCAATGGCGGCATT<br>CCTGACCAGCAAACTTGGCGGCATTCCGGTGAAAGTTTCCCTTAGCC<br>GTGAAGAGTGTTTCCTCGCAACCCGTACCCGCCACGCTTTTACTATTG<br>ACGGGCAAATGGGCGTGAACCGCGACGGAACATTGAAAGGTTATAG<br>TCTGGATGTTCTGTCTAACACCGGCGCTTATGCATCTCACGGGCACTC<br>CATTGCTTCTGCTGGGGGAATAAAGTCGCTTACCTTTATCCTCGTTG<br>TGCCTACGCTTACAGTTCAAAGACCTGCTATACCAACCTCCCCTCGGC<br>TGGTGCGATGCGTGGTTATGGCGCGCCACAAGTCGTATTTGCCGTTG<br>AGTCTATGCTTGATGATGCCGCGACAGCGTTAGGTATTGATCCTGTTG<br>AAATTCGTTTACGCAACGCCGCCCGCAAGGAGATGCTAATCCGCTC<br>ACGGGAAAACGTATTTACAGCGCAGGGTTGCCGGAGTGTCTTGAAAA<br>AGGCCGGAAAATCTTTGAATGGGAAAAACGCCGTGCAGAGTGCCAG<br>AACCAGCAAGGCAATTTACGTCGTGGCGTTGGCGTCGCCTGTTTTAG<br>CTACACCTCTAACACCTGGCCTGTCGGCGTAGAAATAGCAGGCGCGC<br>GCCTGTTGATGAATCAGGATGGAACCATCAACGTGCAAAGCGGCGCG<br>ACGGAAATCGGCCAGGGTGCCGACACCGTGTTCTCGCAAATGGTGGC<br>AGAAAACCGTGGGAGTTCCGGTCAGCGATGTTCACGTTATTTCAACCC |

TABLE 78-continued

Sequences

| Description/ SEQ ID NO | Sequence |
|---|---|
| | AAGATACCGACGTTACACCATTCGACCCCGGCGCATTTGCCTCACGT CAGAGCTATGTTGCCGCGCCTGCGCTGCGCAGTGCAGCACTGTTATT AAAAGAGAAAATCATCGCTCACGCCGCAGTCATGCTACATCAGTCAG CGATGAATCTGACCCTGATAAAAGGCCATATCGTGCTGATTGAAAGA CCGGAAGAACCGTTAATGTCGTTAAAAGATTTGGCGATGGACGCTTT CTACCACCCTGAACGCGGCGGGCAGCTCTCTGCCGAAAGCTCCATCA AAACCACCACTAACCCACCGGCGTTTGGCTGTACCTTTGTTGATCTGA CGGTCGATATTGCACTGTGCAAAGTCACCATCAACCGCATCCTCAAC GTTCATGATTCGGGCCATATTCTTAATCCGCTGCTGGCAGAAGGTCA GGTACACGGCGGAATGGGAATGGGCATTGGCTGGGCGCTATTTGAAG AGATGATCATCGATGCGAAAAGCGGCGTGGTCCGTAACCCCAATCTG CTGGATTACAAAATGCCGACCATGCCGGATCTGCCACAACTGGAAAG CGCGTTCGTCGAAATCAATGAGCCGCAATCAGCATACGGACATAAGT CACTGGGTGAGCCCCCCATAATTCCTGTAGCCGCTGCTATTCGTAACG CGGTGAAGATGGCTACCGGTGTTGCAATCAATACACTGCCGCTAACG CCAAAACGATTATATGAAGAATTCCATCTGGCAGGATTGATTTGAGG ATAACATCATGTTTGATTTTGCTTCTTACCATCGCGCAACCACCCTTG CCGATGCCATCACCCTGCTGGCTGACAATCCGCAGGCCAAATTGCTT GCCGGTGGCACTGACGTACTGATACAGCTTCACCATCACAATGACCG CTATCGCCATATTGTTGATATCCACAATCTGGCAGAGCTTCAGGGAA TAACACAGGCGGAAGATGGCGCGCTGCGAATCGGCTCTGCGACAAC ATTTACTCAGCTCATTGAAGATCCCGTAATCCAACGCAATCTCCCGGC GTTATGTGCTGCGGCTGCATCAATCGCCGGGCCGCAGATCCGTAATG TCGCCACCTACGCGGAAATATTTGCAACGGTGCCACCAGCGCAGAT TCTGCCACGCCAACGCTAATTTATGACGCGAAACTGGAGCTCCACTC CCCACGCGGTGTTCGTTTCGTCCCGATTAATGGCTTTCACACCGGGCC GGGCAAAGTGTCTCTTGAGCATGACGAAATCCTTGTCGCCTTTCATTT TCCGCCACAGCCGAAAGAACACGCGGGCAGCGCGCATTTTAAATATG CCATGCGCGACGCAATGGATATTTCAACAATTGGCTGCGCCGCACAT TGCCGACTGGATAACGGCAATTTCAGCGAATTACGCCTGGCATTTGG TGTTGCCGCGCCAACGCCGATTCGCTGCCAACATGCCGAACAGACTG CACAAAATGCGCCATTAAACCTGCAAACGCTGGAAGCCATCAGCGA ATCAGTCCTGCAAGATGTCGCCCCGCGTTCTTCATGGCGGGCCAGTA AAGAGTTTCGTCTGCATCTCATCCAGACGATGACCAAAAAAGTGATT AGCGAAGCCGTCGCCGCGGCGGGGGGAAAATTGCAATGAATCACAG CGAAACAATTACCATCGAATGCACCATTAACGGGATGCCTTTTCAGC TTCACGCCGCGCCAGGAATGCCGCTTTCGGAACTACTCCGAGAACAA GGGCTTCTTAGTGTCAAACAAGGTTGCTGCGTAGGCGAATGCGGTGC CTGTACGGTGCTGGTCGACGGCACTGCGATAGACAGTTGCTTATTCCT TGCGACCTGGGCTGAAGGAAAAGAGATCCGCACGCTGGAAGGTGAA GCGAAAGGCGGTAAACTTTCTCATGTCCAACTGGCTTATGCGAAATC TGGTGCAGTGCAATGCGGGTTTTGTACGCCGGGCCTGATTATGGCTA CCACGGCGATGCTGGCAAAACCACGCGAAAAACCATTAACCATTACG GAAATTCGTCGTGGACTGGCGGGAAATCTTTGTCGCTGCACGGGGTA TCAGATGATTGTAAATACAGTTCTGGATTGCGAGAAAACGAAGTAA |
| P$_{fnrS}$-add-<br>xapA-deoD<br>SEQ ID<br>NO: 860 | GGTACCAGTTGTTCTTATTGGTGGTGTTGCTTTATGGTTGCATCGTAG TAAATGGTTGTAACAAAAGCAATTTTTCCGGCTGTCTGTATACAAAA ACGCCGTAAAGTTTGAGCGAAGTCAATAAACTCTCTACCCATTCAGG GCAATATCTCTCTTGGATCCAAAGTGAACTCTAGAAATAATTTTGTTT AACTTTAAGAAGGAGATATACATATGATTGATACCACCCTGCCATTA ACTGATATCCATCGCCACCTTGATGGCAACATTCGTCCCCAGACCATT CTTGAACTTGGCCGCCAGTATAATATCTCGCTTCCTGCACAATCCCTG GAAACACTGATTCCCCACGTTCAGGTCATTGCCAACGAACCCGATCT GGTGAGCTTTCTGACTAAACTTGACTGGGGCGTTAAAGTTCTCGCCTC TCTTGATGCCTGCCGCCGCGTGGCATTTGAAAACATTGAAGATGCAG CCCGTAACGGCCTGCACTATGTCGAGCTGCGTTTTTCACCAGGCTACA TGGCAATGGCACATCAGCTGCCTGTAGCGGGTGTTGTCGAAGCGGTG ATCGATGGCGTACGTGAAGGTTGCCGCACCTTTGGTGTGCAGGCGAA GCTTATCGGTATTATGAGCCGGACCTTCGGCGAAGCCGCCTGTCAGC AAGAGCTGGAGGCCTTTTAGCCCACCGTGACCAGATTACCGCACTT GATTTAGCCGGTGATGAACTTGGTTTCCCGGGAAGTCTGTTCCTTTCT CATTTCAACCGCGCGCGTGATGCGGGCTGGCATATTACCGTCCATGC AGGCGAAGCTGCCGGACCGGAAAGCATCTGGCAGGCGATTCGTGAA CTGGGGGCGGAGCGTATTGGACATGGCGTAAAAGCCATTGAAGATC GGGCGCTGATGGATTTTCTCGCCGAGCAACAAATTGGTATTGAATCC TGTCTGACCTCCAATATTCAGACCAGCACCGTGGCGGATCTGGCTGC ACATCCGCTGAAAACGTTCCTTGAGCATGGCATTCGTGCCAGCATTA ACACTGACGATCCAGGCGTGCAGGGAGTGGATATCATTCACGAATAT ACCGTTGCCGCGCCAGCTGCTGGGTTATCCCGCGAGCAAATCCGCCA GGCACAGATTAATGGTCTGGAAATGGCTTTCCTCAGCGCAGAGGAAA AACGCGCACTGCGAGAAAAAGTCGCCGCGAAGTAAAAGAAGGAGAT ATACATATGTATCAGGCTCAGTTTTCTCATAACCCACTGTATTGCGTA GATATTATCAAGACTTATAAACCTGATTTCACGCCACGAGTGGCCTTT |

TABLE 78-continued

Sequences

| Description/<br>SEQ ID<br>NO | Sequence |
|---|---|
| | ATTTTAGGTTCCGGGCTGGGCGCGCTGGCCGATCAGATTGAGAACGC<br>GGTCGCAATTTCCTACGAAAAGCTGCCTGGGTTCCCGGTAAGTACCG<br>TACACGGTCATGCGGGTGAGCTGGTGCTGGGTTATCTCCAGGGGGTG<br>CCAGTGGCGTGTATGAAAGGTCGCGGACATTTCTACGAAGGTCGTGG<br>GATGACCATCATGACGGATGCAATCCGTACCTTTAAGTTGCTGGGCT<br>GCGAGTTGCTGTTCTGCACCAATGCGGCTGGCTCACTGCGCCCTGAA<br>GTGGGGGCCGGCAGTCTGGTCGCATTGAAAGATCACATCAACACCAT<br>GCCGGGAACGCCGATGGTGGGTCTTAATGATGAACGTTTTGGTGAGC<br>GCTTCTTCTCGCTGGCGAATGCCTACGATGCGGAATACCGCGCACTG<br>TTACAAAAAGTGGCGAAAGAAGAGGGGTTCCCTCTGACGGAGGGCG<br>TGTTCGTCTCATATCCGGGGCCGAATTTCGAGACTGCGGCGGAAATT<br>CGCATGATGCAAATTATTGGTGGGGATGTTGTTGGTATGTCTGTGGTG<br>CCTGAGGTTATTTCAGCTCGCCATTGCGAACTTAAAGTCGTTGCGGTC<br>TCTGCGATTACCAACATGGCGGAAGGTCTGAGTGACGTGAAGCTTTC<br>TCATGCCCAAACGCTGGCAGCAGCGGAACTCTCAAAGCAAAACTTTA<br>TTAATCTTATTTGCGGCTTTCTGCGCAAAATTGCCTGAAAGAAGGAG<br>ATATACATATGGCTACCCCACACATTAATGCAGAAATGGGCGATTTC<br>GCTGACGTAGTTTTGATGCCAGGCGACCCGCTGCGTGCGAAGTATAT<br>TGCTGAAACTTTCCTTGAAGATGCCCGTGAAGTGAACAACGTTCGCG<br>GTATGCTGGGCTTCACCGGTACTTACAAAGGCCGCAAAATTTCCGTA<br>ATGGGTCACGGTATGGGTATCCCGTCCTGCTCCATCTACACCAAAGA<br>ACTGATCACCGATTTCGGCGTGAAGAAAATTATCCGCGTGGGTTCCT<br>GTGGCGCAGTTCTGCCGCACGTAAAACTACGCGACGTCGTTATCGGT<br>ATGGGTGCCTGCACCGATTCCAAAGTTAACCGCATCCGTTTTAAAGA<br>CCATGACTTTGCCGCTATCGCTGACTTTGACATGGTGCGTAACGCGGT<br>AGACGCGGCTAAAGCACTGGGCGTTGATGCTCGCGTGGGTAACCTGT<br>TCTCCGCTGACCTGTTCTACTCTCCGGACGGCGAAATGTTCGACGTGA<br>TGGAAAAATACGGCATCCTCGGCGTGGAAATGGAAGCGGCTGGTATC<br>TACGGCGTCGCTGCAGAATTTGGCGCGAAAGCCCTGACCATCTGCAC<br>CGTGTCTGACCACATCCGCACTCACGAGCAGACCACTGCCGCTGAGC<br>GTCAGACCACCTTCAACGACATGATCAAAATCGCACTGGAATCCGTT<br>CTGCTGGGCGATAAAGAGTAA |
| add-xapA-<br>deoD (with<br>RBS<br>underlined)<br>SEQ ID<br>NO: 861 | <u>CTCTAGAAATAATTTTGTTTAACTTTAAGAAGGAGATATACA</u>TATGAT<br>TGATACCACCCTGCCATTAACTGATATCCATCGCCACCTTGATGGCAA<br>CATTCGTCCCCAGACCATTCTTGAACTTGGCCGCCAGTATAATATCTC<br>GCTTCCTGCACAATCCCTGGAAACACTGATTCCCCACGTTCAGGTCAT<br>TGCCAACGAACCCGATCTGGTGAGCTTTCTGACTAAACTTGACTGGG<br>GCGTTAAAGTTCTCGCCTCTCTTGATGCCTGCCGCCGCGTGGCATTTG<br>AAAACATTGAAGATGCAGCCCGTAACGGCCTGCACTATGTCGAGCTG<br>CGTTTTTCACCAGGCTACATGGCAATGGCACATCAGCTGCCTGTAGC<br>GGGTGTTGTCGAAGCGGTGATCGATGGCGTACGTGAAGGTTGCCGCA<br>CCTTTGGTGTGCAGGCGAAGCTTATCGGTATTATGAGCCGGACCTTC<br>GGCGAAGCCGCCTGTCAGCAAGAGCTGGAGGCCTTTTTAGCCCACCG<br>TGACCAGATTACCGCACTTGATTTAGCCGGTGATGAACTTGGTTTCCC<br>GGGAAGTCTGTTCCTTTCTCATTTCAACCGCGCGCGTGATGCGGGCTG<br>GCATATTACCGTCCATGCAGGCGAAGCTGCCGGACCGGAAAGCATCT<br>GGCAGGCGATTCGTGAACTGGGGGCGGAGCGTATTGGACATGGCGT<br>AAAAGCCATTGAAGATCGGGCGCTGATGGATTTTCTCGCCGAGCAAC<br>AAATTGGTATTGAATCCTGTCTGACCTCCAATATTCAGACCAGCACC<br>GTGGCGGATCTGGCTGCACATCCGCTGAAAACGTTCCTTGAGCATGG<br>CATTCGTGCCAGCATTAACACTGACGATCCAGGCGTGCAGGGAGTGG<br>ATATCATTCACGAATATACCGTTGCCGCGCCAGCTGCTGGGTTATCCC<br>GCGAGCAAATCCGCCAGGCACAGATTAATGGTCTGGAAATGGCTTTC<br>CTCAGCGCAGAGGAAAAACGCGCACTGCGAGAAAAAGTCGCCGCGA<br>AGTAA<u>AAGAAGGAGATATACA</u>TATGTATCAGGCTCAGTTTTCTCATA<br>ACCCACTGTATTGCGTAGATATTATCAAGACTTATAAACCTGATTTCA<br>CGCCACGAGTGGCCTTTATTTTAGGTTCCGGGCTGGGCGCGCTGGCC<br>GATCAGATTGAGAACGCGGTCGCAATTTCCTACGAAAAGCTGCCTGG<br>GTTCCCGGTAAGTACCGTACACGGTCATGCGGGTGAGCTGGTGCTGG<br>GTTATCTCCAGGGGGTGCCAGTGGCGTGTATGAAAGGTCGCGGACAT<br>TTCTACGAAGGTCGTGGGATGACCATCATGACGGATGCAATCCGTAC<br>CTTTAAGTTGCTGGGCTGCGAGTTGCTGTTCTGCACCAATGCGGCTGG<br>CTCACTGCGCCCTGAAGTGGGGGCCGGCAGTCTGGTCGCATTGAAAG<br>ATCACATCAACACCATGCCGGGAACGCCGATGGTGGGTCTTAATGAT<br>GAACGTTTTGGTGAGCGCTTCTTCTCGCTGGCGAATGCCTACGATGCG<br>GAATACCGCGCACTGTTACAAAAAGTGGCGAAAGAAGAGGGGTTCCC<br>TCTGACGGAGGGCGTGTTCGTCTCATATCCGGGGCCGAATTTCGAG<br>ACTGCGGCGGAAATTCGCATGATGCAAATTATTGGTGGGGATGTTGT<br>TGGTATGTCTGTGGTGCCTGAGGTTATTTCAGCTCGCCATTGCGAACT<br>TAAAGTCGTTGCGGTCTCTGCGATTACCAACATGGCGGAAGGTCTGA<br>GTGACGTGAAGCTTTCTCATGCCCAAACGCTGGCAGCAGCGGAACTC<br>TCAAAGCAAAACTTTATTAATCTTATTTGCGGCTTTCTGCGCAAAATT<br>GCCTGA<u>AAGAAGGAGATATACA</u>TATGGCTACCCCACACATTAATGCA |

TABLE 78-continued

Sequences

Description/
SEQ ID
NO      Sequence

GAAATGGGCGATTTCGCTGACGTAGTTTTGATGCCAGGCGACCCGCT
GCGTGCGAAGTATATTGCTGAAACTTTCCTTGAAGATGCCCGTGAAG
TGAACAACGTTCGCGGTATGCTGGGCTTCACCGGTACTTACAAAGGC
CGCAAAATTTCCGTAATGGGTCACGGTATGGGTATCCCGTCCTGCTCC
ATCTACACCAAAGAACTGATCACCGATTTCGGCGTGAAGAAAATTAT
CCGCGTGGGTTCCTGTGGCGCAGTTCTGCCGCACGTAAAACTACGCG
ACGTCGTTATCGGTATGGGTGCCTGCACCGATTCCAAAGTTAACCGC
ATCCGTTTTAAAGACCATGACTTTGCCGCTATCGCTGACTTTGACATG
GTGCGTAACGCGGTAGACGCGGCTAAAGCACTGGGCGTTGATGCTCG
CGTGGGTAACCTGTTCTCCGCTGACCTGTTCTACTCTCCGGACGGCGA
AATGTTCGACGTGATGGAAAAATACGGCATCCTCGGCGTGGAAATGG
AAGCGGCTGGTATCTACGGCGTCGCTGCAGAATTTGGCGCGAAAGCC
CTGACCATCTGCACCGTGTCTGACCACATCCGCACTCACGAGCAGAC
CACTGCCGCTGAGCGTCAGACCACCTTCAACGACATGATCAAAATCG
CACTGGAATCCGTTCTGCTGGGCGATAAAGAGTAA

In some embodiments, genetically engineered bacteria comprise a nucleic acid sequence that is at least about 80%, at least about 85%, at least about 90%, at least about 95%, or at least about 99% homologous to the DNA sequence of SEQ ID NO: 856, SEQ ID NO: 857, SEQ ID NO: 858, SEQ ID NO: 859, SEQ ID NO: 860, and/or SEQ ID NO: 861.

Example 26. In Vitro Adenosine Degradation Measurements

In Vitro Adenosine Consumption

Glucose is the preferred carbon source of *E. coli*. However, *E. coli* can also use adenosine as a sole source of carbon in the absence of glucose. To assess the ability of the newly generated strains to degrade adenosine, and if able to do so even in the presence of the preferred carbon source, glucose.

To accomplish this, overnight cultures of each strain including a wild type control were grown in LB at 37 C, shaking at 250 rpm. Cultures were back diluted 1:100 (10 mL in 125 mL baffled flask) and grown for 1.5 hours to early log phase. Once cultures reached early log, cultures were moved into a Coy anaerobic chamber supplying an anaerobic atmosphere (85% $N_2$, 10% $CO_2$, 5% $H_2$). Cultures were incubated anaerobically for 4 hours to allow for induction of the engineered adenosine degradation pathway gene(s).

Cultures were removed from the anaerobic chamber and tested for adenosine degradation activity. To accomplish this, ~1e8 activated bacterial cells were spun down in 1.5 mL microcentrifuge tubes and resuspended in adenosine assay buffer (1×M9 minimal media containing 10 mM adenosine that either contained no glucose or 0.5% glucose (see slide)). Tubes were incubated statically at 37 degrees Celsius for 5 h, and supernatant samples were removed every hour for 5 h. Supernatant samples were analyzed via LC-MS for determination of adenosine concentration.

Figure 5:
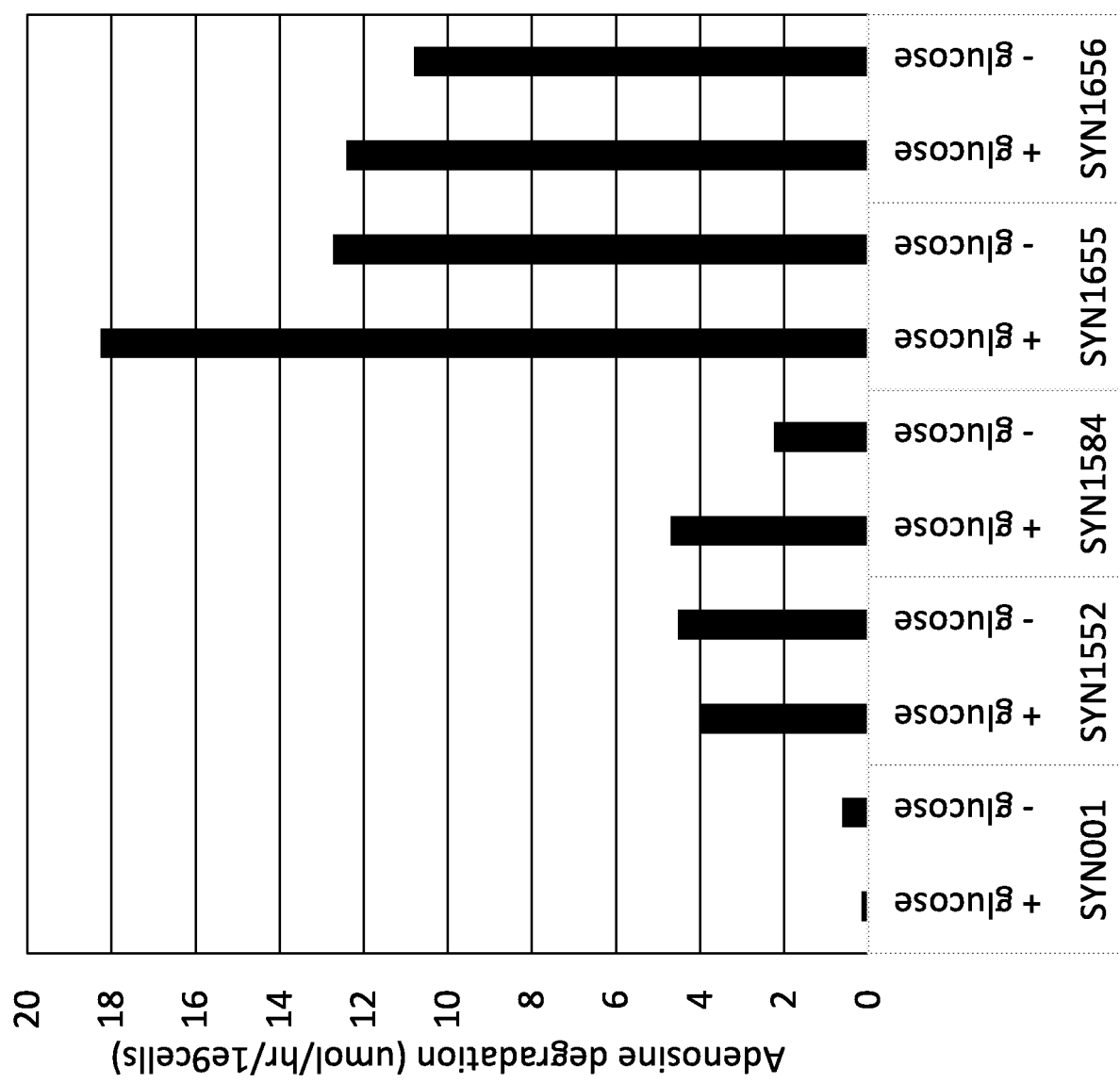
FIG. 5 depicts a bar graph showing that strains SYN1565 (comprising PfnrS-nupC), SYN1584 (comprising PfnrS-nupC; PfnrS-xdhABC) SYN1655 (comprising PfnrS-nupC; PfnrS-add-xapA-deoD) and SYN1656 (comprising PfnrS-nupC; PfnrS-xdhABC; PfnrS-add-xapA-deoD) can degrade adenosine in vitro, even when glucose is present.

Results are show in FIG. 5. and indicate that all engineered strains were able to degrade adenosine (determined by its absence in the supernatant samples) at a rate higher than that of the wild type control strain. All strains were able to degrade adenosine regardless whether *E. coli*'s preferred carbon source, glucose, was present.

In Vitro Activity Under Substrate Limited Conditions

In the previous study, substrate was not limiting, i.e., strains were able to function at $V_{max}$. Such substrate concentrations were far in excess of concentrations expected in vivo. Next, adenosine degradation ability of the engineered bacteria was assessed at more limiting substrate concentrations (more consistent with adenosine concentrations in a tumor in vivo), and at lower doses (more consistent with doses which can be administered IV or IT in a mouse without causing sepsis).

Overnight cultures of each strain were grown in LB at 37 C, shaking at 250 rpm. Cultures were back diluted 1:100 (10 mL in 125 mL baffled flask) and grown for 1.5 hours to early log phase. Once cultures reached early log, they were moved into a Coy anaerobic chamber supplying an anaerobic atmosphere (85% $N_2$, 10% $CO_2$, 5% $H_2$). Cultures were incubated anaerobically for 4 hours to allow for induction of the engineered adenosine degradation pathway gene(s).

Activated cells were quantitated on a cellometer and diluted in PBS to 5e8 cfu/mL. 10 uL of this suspension (comprising 5e6 bacteria) were resuspended in 1 mL of adenosine assay buffer comprised of M9 minimal media, 0.5% glucose, and 100 uM adenosine. Cells were incubated statically at 37 C. Supernatant samples were removed every hour for 5 hours to determine rates of adenosine degradation. Supernatant samples were analyzed via LC-MS for determination of adenosine concentration. Rates of degradation reported are the maximal linear rates between 0 to 5 hours of sampling (this may not include the later time points as rates may not be linear at extremely low substrate (adenosine) degradation).

Figure 6:
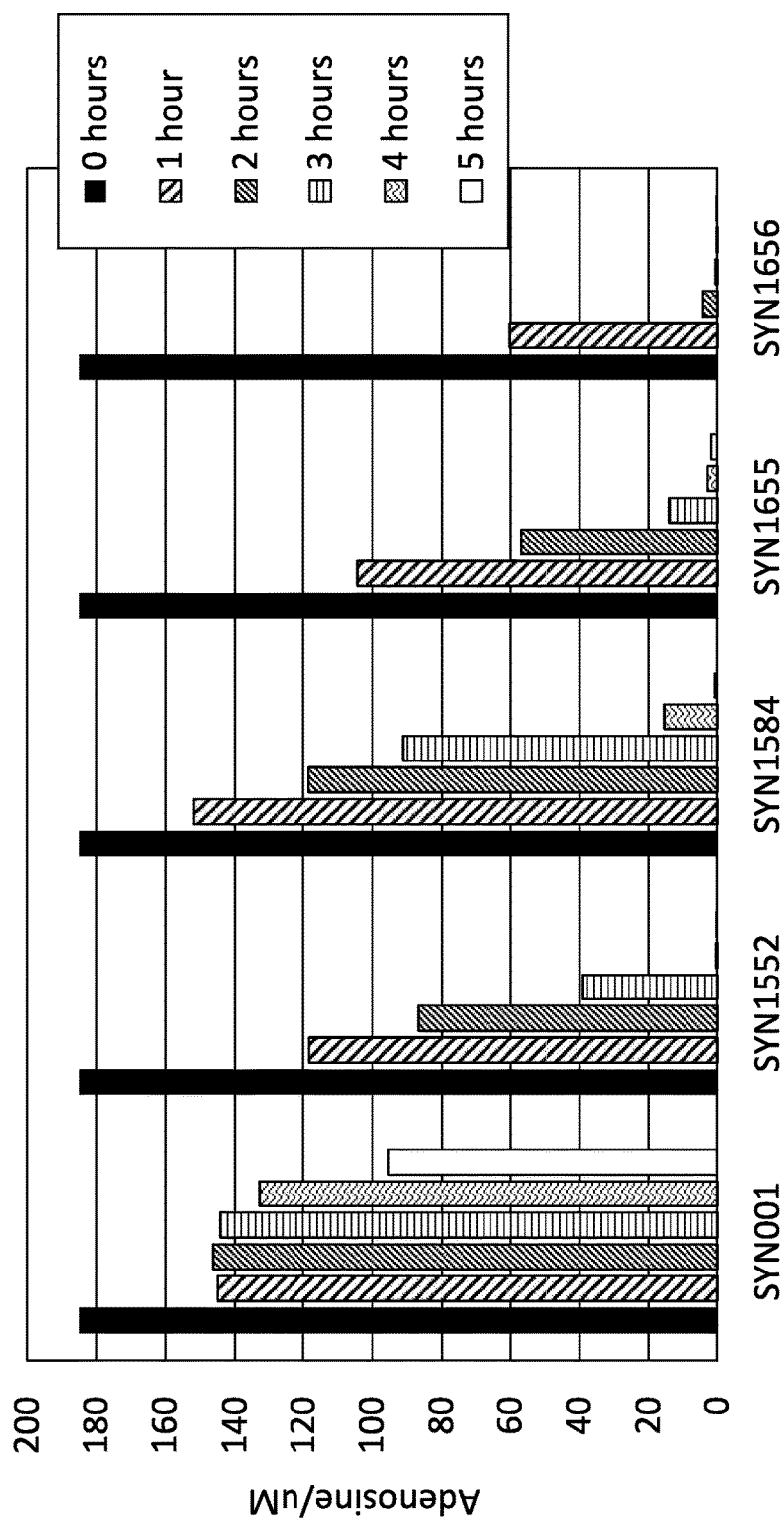
FIG. 6 depicts a bar graph showing adenosine degradation at substrate limiting conditions, in the presence of 1 uM adenosine, which corresponds to adenosine levels expected in the in vivo tumor environment. The results show that a low concentration of activated SYN1656 ($1\times10^6$ cells), (and also other strains depicted), are capable of degrading adenosine below the limit of quantitation.

Results are shown in FIG. 6 and indicate that all engineered strains were able to degrade adenosine (determined by its absence in the supernatant samples) at a rate higher than that of control strain SYN01. SYN1656, the most highly engineered strain containing all three integrations comprising the adenosine degradation pathway, was able to degrade adenosine at the highest rate and to take adenosine levels to undetectable levels by 3 hours.

The linear rate is shown in Table 79.

TABLE 79

Linear Adenosine Degradation Rates

| | Linear Rate (umol/hr/$10^9$ cells) |
|---|---|
| SYN001 | 1.95 |
| SYN1552 | 5.90 |
| SYN1584 | 6.39 |

TABLE 79-continued

Linear Adenosine Degradation Rates

| | Linear Rate (umol/hr/$10^9$ cells) |
|---|---|
| SYN1655 | 5.65 |
| SYN1656 | 6.88 |

Example 27. Effect of Adenosine Consuming Strains In Vivo

The effects of an adenosine consuming strain SYN1656 (comprising $P_{fnrs}$-nupC; $P_{fnrs}$-xdhABC; $P_{fnrs}$-add-xapA-deoD) in vivo was assessed, alone and in combination with anti-PD1.

CT26 cells obtained from ATCC were cultured according to guidelines provided. Approximately ~1e6 cells/mouse in PBS were implanted subcutaneously into the right flank of each animal (BalbC/J (female, 8 weeks)), and tumor growth was monitored for approximately 10 days. When the tumors reached about ~100-150 mm3, animals were randomized into groups for dosing.

To prepare the cells, streptomycin resistant Nissle (SYN094) was grown in LB broth until reaching an absorbance at 600 nm (A600 nm) of 0.4 (corresponding to 2×108 colony-forming units (CFU)/mL) and washed twice in PBS. The suspension was diluted in PBS or saline so that 100 microL can be injected at the appropriate doses intratumorally into tumor-bearing mice. To prepare the SYN1656, cells were diluted 1:100 in LB (2 L), grown for 1.5 h aerobically, then shifted to the anaerobe chamber for 4 hours. Prior to administration, cells were concentrated 200× and frozen (15% glycerol, 2 g/L glucose, in PBS).

Approximately 10 days after CT 26 implantation, on day 1, bacteria were suspended in 0.1 ml of PBS and mice were weighed, measured, and randomized into treatment groups as follows: Group 1 saline injection (100 ul) (n=14); Group 2 SYN94 IT 10e7 (n=14); Group 3-SYN1656 IT 10e7 (n=14); Group 4-SYN1656 IT 10e7 plus aPD-1 (BioXcell), 10 mg/kg, i.p. (n=14); Group 5-aPD-1 (BioXcell), 10 mg/kg, i.p (n=9).

Figure 7:
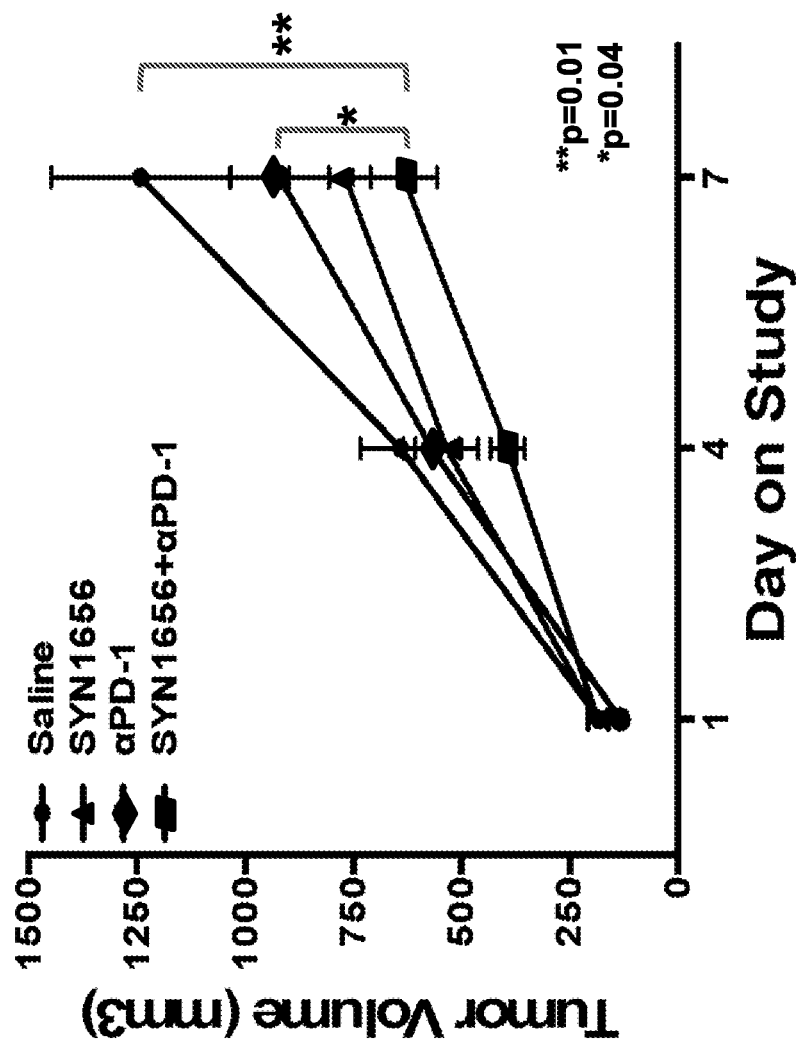
FIG. 7 depicts a line graph of an in vivo analysis of the effect of adenosine consumption by engineered *E. coli* Nissle (SYN1656), alone or in combination with anti-PD1, on tumor volume. The data suggest anti-tumor activity of adenosine-consuming strain as single agent and in combination with aPD-1.
Figure 8A:
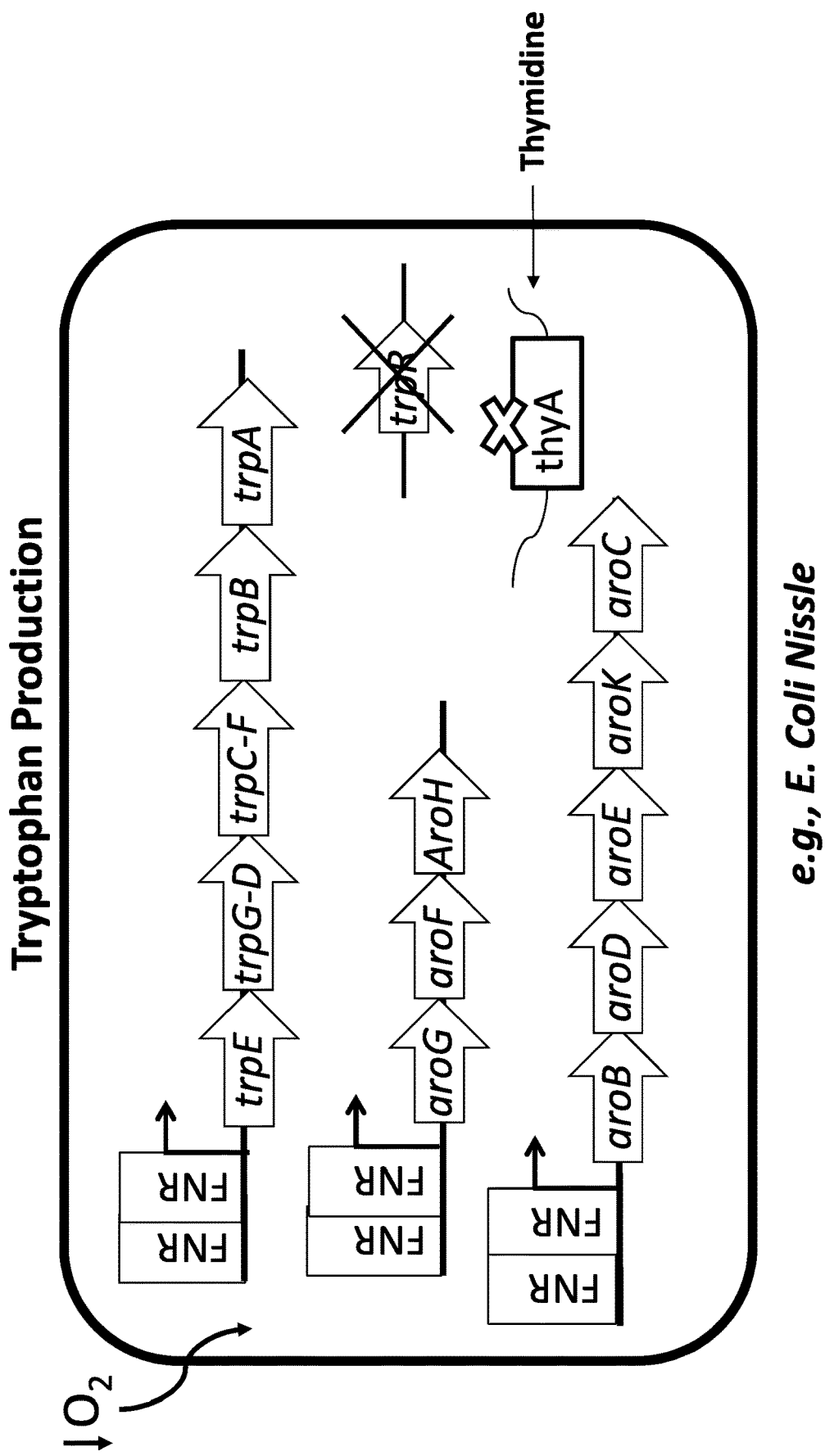
FIG. 8A, FIG. 8B, FIG. 8C, and FIG. 8D depict schematics of exemplary embodiments of the disclosure, in which the genetically engineered bacteria comprise circuits for the production of tryptophan. Such gene sequences can be located on a plasmid in the microorganism or can be integrated into the chromosome. Any of the gene(s), gene sequence(s) and/or gene circuit(s) or cassette(s) are optionally expressed from an inducible promoter. Exemplary inducible promoters which may control the expression of the gene(s), gene sequence(s) and/or gene circuit(s) or cassette(s) include oxygen level-dependent promoters (e.g., FNR-inducible promoter), and promoters induced by inflammation or an inflammatory response (RNS, ROS promoters). For example, such inducible promoters may be induced under low-oxygen conditions, such as an FNR promoter (depicted). In other embodiments, the promoters are induced in the presence of certain molecules or metabolites, e.g., in the presence of molecules or metabolites associated with the tumor microenvironment and/or with immune suppression. In some embodiments, the promoters are induced in certain tissue types. In some embodiments, promoters are induced in the presence of certain gut-specific molecules or metabolites. In some embodiments, the promoters are induced in the presence of some other metabolite that may or may not be present in the gut or the tumor, such as arabinose or another chemical or nutritional inducer known in the art or described herein. In certain embodiments, the one or more cassettes are under the control of constitutive promoters described herein or known in the art, e.g, whose expression can be fine-tuned using ribosome binding sites of different strengths. Such microorganisms optionally also comprise an auxotrophy, e.g., deltaThyA or deltaDapA.
Figure 8B:
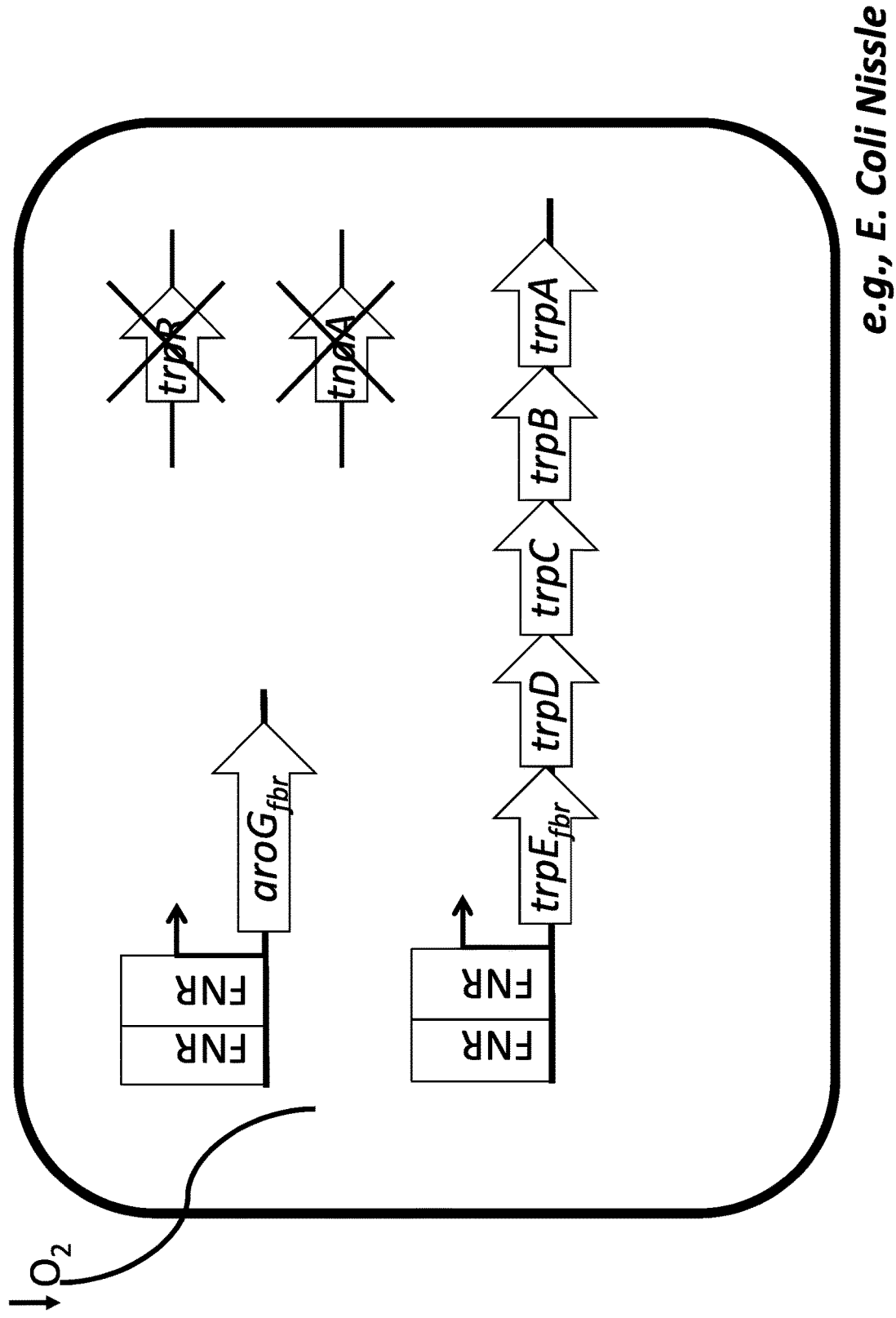
Figure 8C:
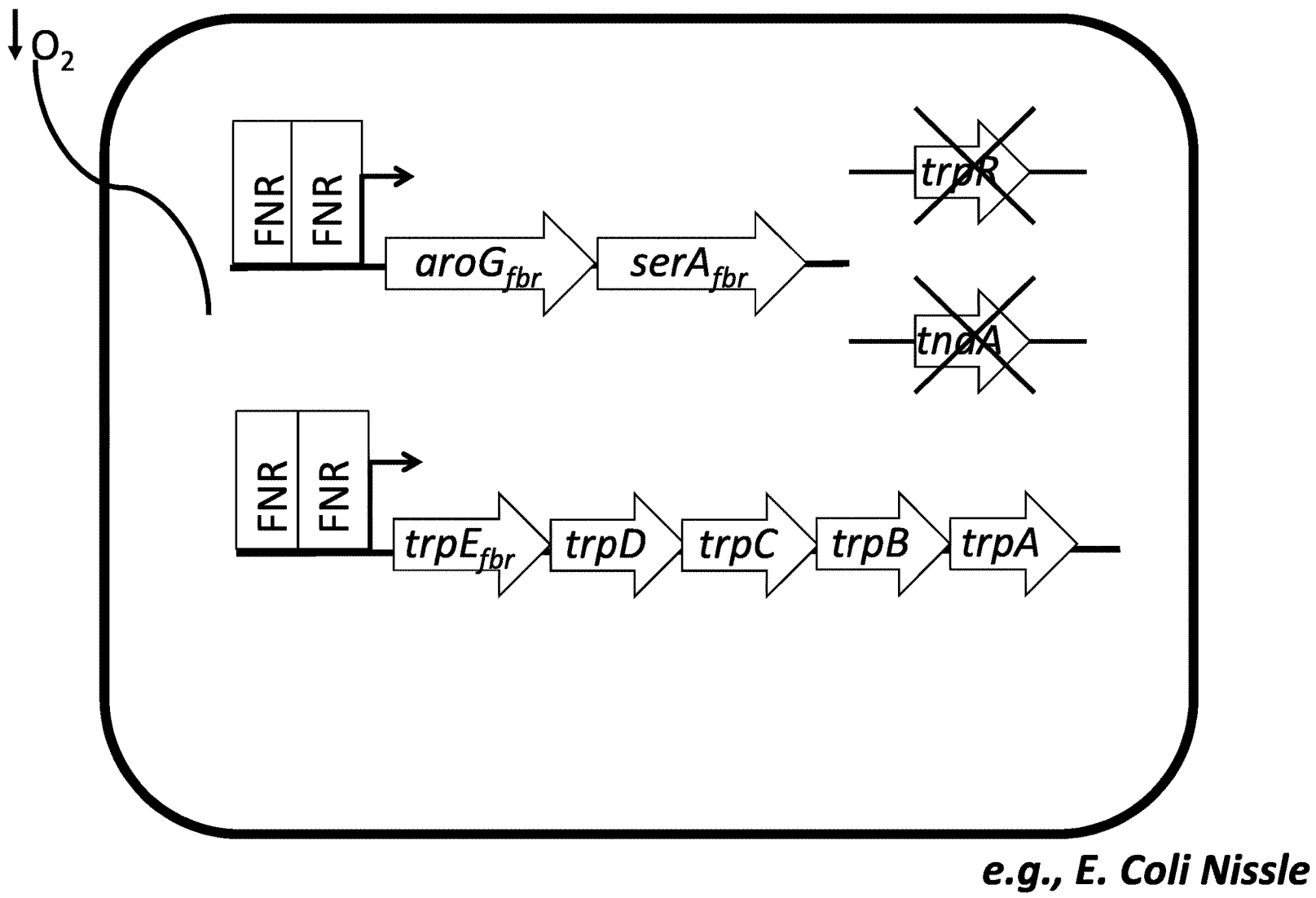
Figure 8D:
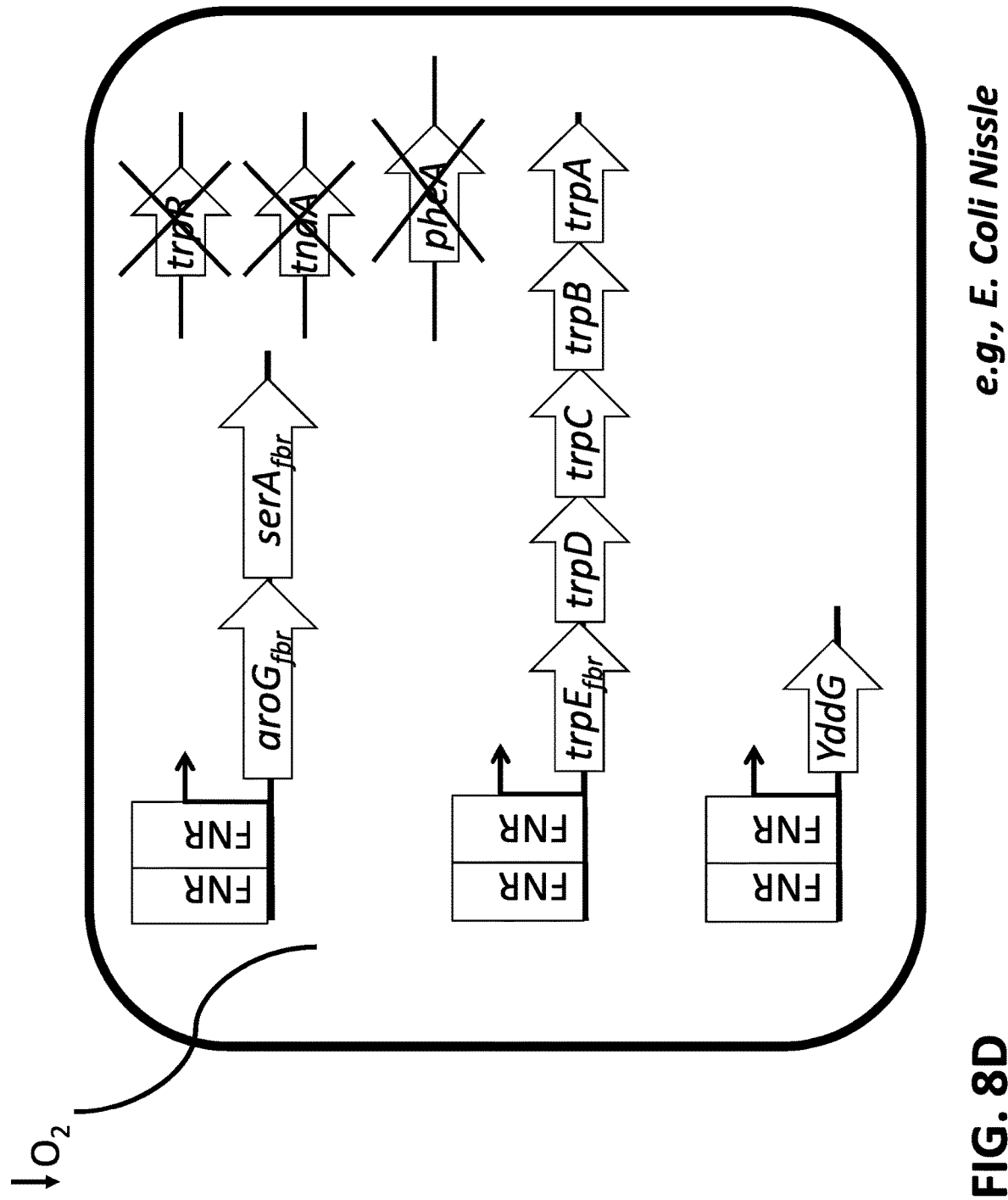
Figure 9:
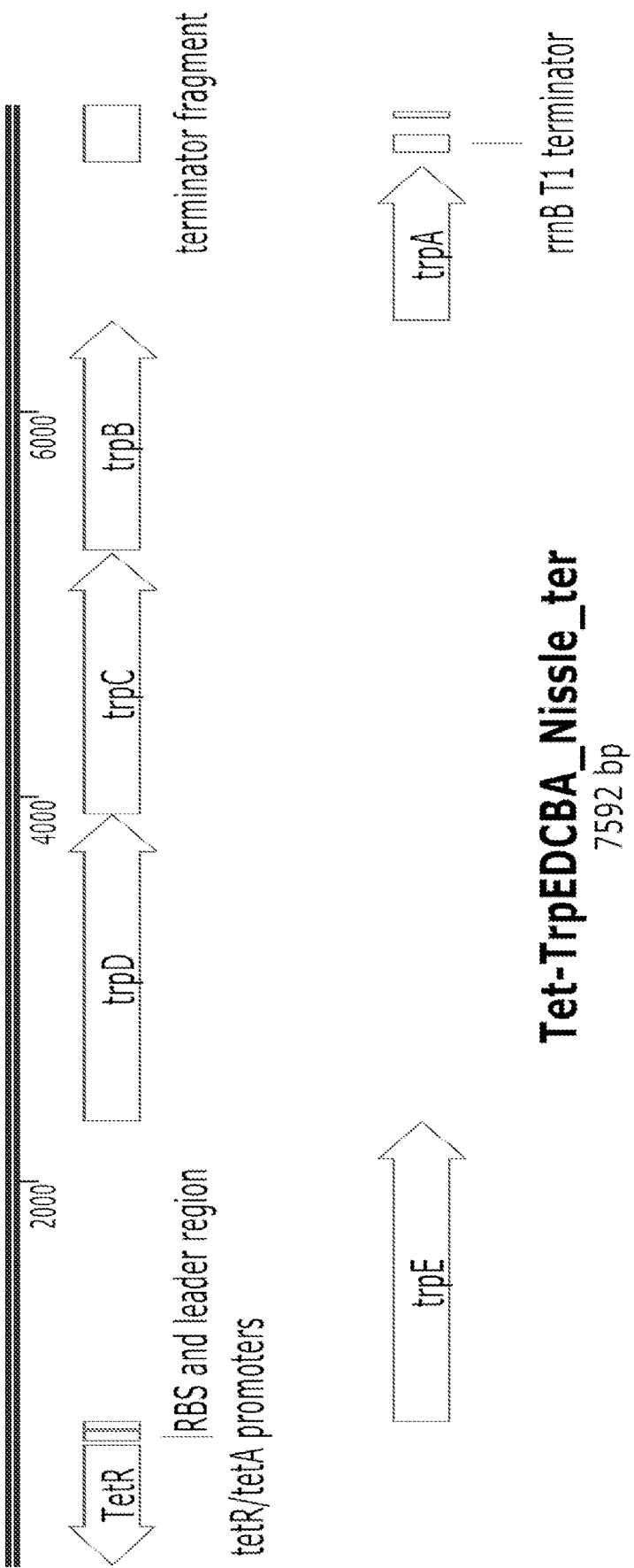
FIG. 9 depicts one embodiment of the disclosure in which the *E. coli* TRP synthesis enzymes are expressed from a construct under the control of a tetracycline inducible system.

On day 1 and day 4, animals were dosed according to their grouping either with saline or with the strains intratumorally (IT) alone or in combination with anti-PD1 (I.P). Plasma and were collected for further analysis. FIG. 7 shows the tumor volume of the mice from day 1, 4, and 7. Results show that the tumor volume is decreased in all three treatment groups (SYN1656, anti-PD1, and SYN1656 plus anti-PD1) as compared to the saline treated controls at 7 days; tumor size is smallest in the SYN1656 and anti-PD1 treated group, followed by SYN1656 alone and anti-PD1 alone, indicating that there may be a synergistic effect between the two treatments, and suggesting anti-tumor activity of adenosine-consuming strain as single agent and in combination with aPD-1. Tumor volume was significantly lower in the animals treated with SYN1656 and anti-PD1 than with saline alone (p=0.01). Tumor volume of animals treated with SYN1656 and anti-PD1 was also significantly lower than animals treated with anti-PD1 alone.

In other studies, this study is extended to include dosing and analysis at days 10, 15, and 18, until animals reach a tumor size of approximately 2000 mm$^3$.

Example 28. Adenosine Quantification in Bacterial Supernatant by LC-MS/MS

Sample Preparation

Adenosine standards were prepared in water (250, 100, 20, 4, 0.8, 0.16, 0.032 m/mL). Sample (10 μL) (and standards) were mixed with 90 μL of ACN/H$_2$O (60:30, v/v) containing 1 μg/mL of Adenosine-13C$_5$ in the final solution) in a V-bottom 96-well plate. The plate was heat sealed with a AlumASeal foil, mixed well, and centrifuged at 4000 rpm for 5 min. The solution (10 μL) was transferred into a round-bottom 96-well plate and add 90 uL 0.1% formic acid in water was added to the sample. The plate was heat-sealed with a ClearASeal sheet and mixed well.

LC-MS/MS Method

Adenosine was measured by liquid chromatography coupled to tandem mass spectrometry (LC-MS/MS) using a Thermo TSQ Quantum Max triple quadrupole mass spectrometer. Table 80, Table 81, and Table 82 provide the summary of the LC-MS/MS method.

TABLE 80

| LC-MS/MS Method | |
|---|---|
| Column: | Accucore aQ column, 2.6 μm (100 × 2.1 mm) |
| Mobile Phase A: | 99.9% H2O, 0.1% Formic Acid |
| Mobile Phase B: | 99.9% ACN, 0.1% Formic Acid |
| Injection volume: | 10 uL |

TABLE 81

| HPLC Method | | | |
|---|---|---|---|
| Time (min) | Flow Rate (μL/min) | A % | B % |
| −0.5 | 350 | 100 | 0 |
| 0.5 | 350 | 100 | 0 |
| 1.0 | 350 | 10 | 90 |
| 2.5 | 350 | 10 | 90 |
| 2.51 | 350 | 100 | 10 |

TABLE 82

| Tandem Mass Spectrometry | |
|---|---|
| Ion Source: | HESI-II |
| Polarity: | Positive |
| SRM transitions: | |
| Adenosine: | 268.1/119.2 |
| Adenosine-13C$_5$: | 273.1/136.2 |

Example 29. Adenosine Quantification in Tumor Tissue by LC-MS/MS

Sample Preparation

Adenosine standards were prepared in water (100, 20, 4, 0.8, 0.16, 0.032, 0.0064 μg/m). Weighed tumor tissues were homogenized with PBS in BeadBug prefilled tubes using a FastPrep homogenizer. The homogenate was transferred into a V-bottom 96-well plate and centrifuged at 4000 rpm for 10 min Sample (40 μL) (and standards) were mixed with 90 μL of with 60 μL of ACN containing 1 μg/mL of Adenosine- 13C$_5$ in the final solution in a V-bottom 96-well plate. The plate was heat sealed with a AlumASeal foil, mixed well, and centrifuged at 4000 rpm for 5 min. The solution (10 μL) was transferred into a round-bottom 96-well plate and add 90 uL 0.1% formic acid in water was added to the sample. The plate was heat-sealed with a ClearASeal sheet and mixed well.

LC-MS/MS Method

Adenosine was measured by liquid chromatography coupled to tandem mass spectrometry (LC-MS/MS) using a Thermo TSQ Quantum Max triple quadrupole mass spectrometer. Table 83, Table 84, and Table 85 provide the summary of the LC-MS/MS method.

TABLE 83

| LC-MS/MS Method | |
|---|---|
| Column: | Accucore aQ column, 2.6 μm (100 × 2.1 mm) |
| Mobile Phase A: | 99.9% H2O, 0.1% Formic Acid |
| Mobile Phase B: | 99.9% ACN, 0.1% Formic Acid |
| Injection volume: | 10 uL |

TABLE 84

| HPLC Method | | | |
|---|---|---|---|
| Time (min) | Flow Rate (μL/min) | A % | B % |
| −0.5 | 350 | 100 | 0 |
| 0.5 | 350 | 100 | 0 |
| 1.0 | 350 | 10 | 90 |
| 2.5 | 350 | 10 | 90 |
| 2.51 | 350 | 100 | 10 |

TABLE 85

| Tandem Mass Spectrometry | |
|---|---|
| Ion Source: | HESI-II |
| Polarity: | Positive |
| SRM transitions: | |
| Adenosine: | 268.1/119.2 |
| Adenosine-13C$_5$: | 273.1/136.2 |

Example 30. Synthesis of Constructs for Tryptophan Biosynthesis

Various constructs are synthesized, and cloned into vector pBR322 for transformation of *E. coli*. In some embodiments, the constructs encoding the effector molecules are integrated into the genome.

TABLE 86

Tryptophan Production Construct Sequences

| Description | Sequence |
|---|---|
| fbrAroG (RBS and leader region underlined) SEQ ID NO: 868 | Ctctagaaataattttgtttaactttaagaaggagatatacat<br>atgaattatcagaacgacgatttacgcatcaaagaaatcaaagagttacttcctcctgtcgcattgctggaa<br>aaattccccgctactgaaaatgccgcgaatacggtcgcccatgcccgaaaagcgatccataagatcctg<br>aaaggtaatgatgatcgcctgttggtggtgattggcccatgctcaattcatgatcctgtcgcggctaaagag<br>tatgccactcgcttgctgacgctgcgtgaagagctgcaagatgagctggaaatcgtgatgcgcgtctatttt<br>gaaaagccgcgtactacggtgggctggaaagggctgattaacgatccgcatatggataacagcttccag<br>atcaacgacggtctgcgtattgcccgcaaattgctgctcgatattaacgacagcggtctgccagcggcgg<br>gtgaattcctggatatgatcaccctacaatatctcgctgacctgatgagctggggcgcaattggcgcacgt<br>accaccgaatcgcaggtgcaccgcgaactggcgtctggtctttcttgtccggtaggtttcaaaaatggcac<br>tgatggtacgattaaagtggctatcgatgccattaatgccgccggtgcgccgcactgcttcctgtccgtaa<br>cgaaatgggggcattcggcgattgtgaataccagcggtaacggcgattgccatatcattctgcgcggcg<br>gtaaagagcctaactacagcgcgaagcacgttgctgaagtgaaagaagggctgaacaaagcaggcct<br>gccagcgcaggtgatgatcgatttcagccatgctaactcgtcaaaacaattcaaaaagcagatggatgttt<br>gtactgacgtttgccagcagattgccggtggcgaaaaggccattattggcgtgatggtggaaagccatct<br>ggtggaaggcaatcagagcctcgagagcggggaaccgctggcctacggtaagagcatcaccgatgcc<br>tgcattggctgggatgataccgatgctctgttacgtcaactggcgagtgcagtaaaagcgcgtcgcgggt<br>aa |
| fbrAroG SEQ ID NO: 862 | atgaattatcagaacgacgatttacgcatcaaagaaatcaaagagttacttcctcctgtcgcattgctggaa<br>aaattccccgctactgaaaatgccgcgaatacggtcgcccatgcccgaaaagcgatccataagatcctg<br>aaaggtaatgatgatcgcctgttggtggtgattggcccatgctcaattcatgatcctgtcgcggctaaagag<br>tatgccactcgcttgctgacgctgcgtgaagagctgcaagatgagctggaaatcgtgatgcgcgtctatttt<br>gaaaagccgcgtactacggtgggctggaaagggctgattaacgatccgcatatggataacagcttccag<br>atcaacgacggtctgcgtattgcccgcaaattgctgctcgatattaacgacagcggtctgccagcggcgg<br>gtgaattcctggatatgatcaccctacaatatctcgctgacctgatgagctggggcgcaattggcgcacgt<br>accaccgaatcgcaggtgcaccgcgaactggcgtctggtctttcttgtccggtaggtttcaaaaatggcac<br>tgatggtacgattaaagtggctatcgatgccattaatgccgccggtgcgccgcactgcttcctgtccgtaa<br>cgaaatgggggcattcggcgattgtgaataccagcggtaacggcgattgccatatcattctgcgcggcg<br>gtaaagagcctaactacagcgcgaagcacgttgctgaagtgaaagaagggctgaacaaagcaggcct<br>gccagcgcaggtgatgatcgatttcagccatgctaactcgtcaaaacaattcaaaaagcagatggatgttt<br>gtactgacgtttgccagcagattgccggtggcgaaaaggccattattggcgtgatggtggaaagccatct<br>ggtggaaggcaatcagagcctcgagagcggggaaccgctggcctacggtaagagcatcaccgatgcc<br>tgcattggctgggatgataccgatgctctgttacgtcaactggcgagtgcagtaaaagcgcgtcgcgggt<br>aa |

TABLE 86-continued

Tryptophan Production Construct Sequences

| Description | Sequence |
| --- | --- |
| fbrAroG-serA (RBS and leader region underlined; SerA starts after second RBS) SEQ ID NO: 863 | <u>Ctctagaaataattttgtttaacttttaagaaggagatatacat</u>atgaattatcagaacgacgatttacgcatca aagaaatcaaagagttacttcctcctgtcgcattgctggaaaaattccccgctactgaaaatgccgcgaat acggtcgcccatgcccgaaaagcgatccataagatcctgaaaggtaatgatgatcgcctgttggtggtga ttggcccatgctcaattcatgatcctgtcgcggctaaagagtatgccactcgcttgctgacgctgcgtgaa gagctgcaagatgagctggaaatcgtgatgcgcgtctattttgaaaagccgcgtactacggtgggctgga aagggctgattaacgatccgcatatggataacagcttccagatcaacgacggtctgcgctattgcccgcaa attgctgctcgatattaacgacagcggtctgccagcggcgggtgaattcctggatatgatcaccctacaat atctcgctgacctgatgagctgggcgcaattggcgcacgtaccaccgaatcgcaggtgcaccgcgaa ctggcgtctggtctttcttgtccggtaggtttcaaaaatggcactgatggtacgattaaagtggctatcgatg ccattaatgccgccggtgcgccgcactgcttcctgtccgtaacgaaatgggggcattcggcgattgtgaa taccagcggtaacggcgattgccatatcattctgcgcggcggtaaagagcctaactacagcgcgaagca cgttgctgaagtgaaagaagggctgaacaaagcaggcctgccagcgcaggtgatgatcgatttcagcc atgctaactcgtcaaaacaattcaaaaagcagatggatgtttgtactgacgtttgccagcagattgccggtg gcgaaaaggccattattggcgtgatggtggaaagccatctggtggaaggcaatcagagcctcgagagc ggggaaccgctggcctacggtaagagcatcaccgatgcctgcattggctgggatgataccgatgctctg ttacgtcaactggcgagtgcagtaaaagcgcgtcgcgggtaaTACT <u>taagaaggagatatacat</u>atggcaaaggtatcgctggagaaagacaagattaagtttctgctggtagaag gcgtgcaccaaaaggcgctggaaagccttcgtgcagctggttacaccaacatcgaatttcacaaaggcg cgctggatgatgaacaattaaaagaatccatccgcgatgcccacttcatcggcctgcgatcccgtacccat ctgactgaagacgtgatcaacgccgcagaaaaactggtcgctattggctgtttctgtatcggaacaaatca ggttgatctgatgcggcggcaaagcgcggatcccggtatttaacgcaccgttctcaaatacgcgctct gttgcggagctggtgattggcgaactgctgctgtactgccggcgtgccagaagccaatgctaaagcg catcgtggcgtgtggaacaaactggcggcgggttcttttgaagcgcgcggcaaaaagctgggtatcatc ggctacggtcatattggtacgcaattgggcattctggctgaatcgctgggaatgtatgtttacttttatgatatt gaaaacaaactgccgctgggcaacgccactcaggtacagcatctttctgacctgctgaatatgagcgatg tggtgagtctgcatgtaccagagaatccgtccaccaaaaatatgatgggcgcgaaagagatttcgctaat gaagcccggctcgctgctgattaatgcttcgcgcggtactgtggtggatattccagcgctgtgtgacgcg ctggcgagcaaacatcggcggggcggcaatcgacgtattcccgacggaaccggcgaccaatagcg atccatttacctctccgctgtgtgaattcgacaatgtccttctgacgccacacattggcggttcgactcagga agcgcaggagaatatcggcttggaagttgcgggtaaattgatcaagtattctgacaatggctcaacgctct ctgcggtgaacttcccggaagtctcgctgccactgcacggtgggcgtcgtctgatgcacatccacgaaa accgtccgggcgtgctaactgcgctcaacaaaatttttgccgagcagggcgtcaacatcgccgcgcaat atctacaaacttccgcccagatgggttatgtagttattgatattgaagccgacgaagacgttgccgaaaaa gcgctgcaggcaatgaaagctattccgggtaccattcgcgcccgtctgctgtactaa |
| SerA (RBS underlined) SEQ ID NO: 864 | atggcaaaggtatcgctggagaaagacaagattaagtttctgctggtagaaggcgtgcaccaaaaggcg ctggaaagccttcgtgcagctggttacaccaacatcgaatttcacaaaggcgcgctggatgatgaacaatt aaaagaatccatccgcgatgcccacttcatcggcctgcgatcccgtacccatctgactgaagacgtgatc aacgccgcagaaaaactggtcgctattggctgtttctgtatcggaacaaatcaggttgatctggatgcggc ggcaaagcgcgggatcccggtatttaacgcaccgttctcaaatacgcgctctgttgcggagctggtgatt ggcgaactgctgctgctattgcgcggcgtgccagaagccaatgctaaagcgcatcgtggcgtgtggaac aaactggcggcgggttcttttgaagcgcgcggcaaaaagctgggtatcatcggctacggtcatattggta cgcaattgggcattctggctgaatcgctgggaatgtatgtttacttttatgatattgaaaacaaactgccgct gggcaacgccactcaggtacagcatctttctgacctgctgaatatgagcgatgtggtgagtctgcatgtac cagagaatccgtccaccaaaaatatgatgggcgcgaaagagatttcgctaatgaagcccggctcgctgc tgattaatgcttcgcgcggtactgtggtggatattccagcgctgtgtgacgcgctggcgagcaaacatctg gcggggcggcaatcgacgtattcccgacggaaccggcgaccaatagcgatccatttacctctccgctg tgtgaattcgacaatgtccttctgacgccacacattggcggttcgactcaggaagcgcaggagaatatcg gcttggaagttgcgggtaaattgatcaagtattctgacaatggctcaacgctctctgcggtgaacttcccgg aagtctcgctgccactgcacggtgggcgtcgtctgatgcacatccacgaaaaccgtccgggcgtgctaa ctgcgctcaacaaaatttttgccgagcagggcgtcaacatctacaaacttccgccca gatgggttatgtagttattgatattgaagccgacgaagacgttgccgaaaaagcgctgcaggcaatgaaa gctattccgggtaccattcgcgcccgtctgctgtactaa |
| TrpEDCBA (RBS and leader region underlined) SEQ ID NO: 872 | <u>Ctctagaaataattttgtttaacttttaagaaggagatatacat</u> atgcaaacacaaaaaccgactctcgaactgctaacctgcgaaggcgcttatcgcgacaacccgactgcg cttttttcaccagttgtgtggggatcgtccggcaacgctgctgctggaatccgcagatatcgacagcaaaga tgatttaaaaagcctgctgctggtagacagtgcgctgcgcattacagcattaagtgacactgtcacaatcc aggcgcttccggcaatggagaagcctgttgacactggtaacgccttgcctgcggtgtggaaaa tgaacaatcaccaaactgccgcgtactgcgcttcccgcctgtcagtccactgctggatgaagacgccgc ttatgctcccttcggtttttgacgctttccgcttattacagaatctgttgaatgtaccgaaggaagaacgaga agcaatgttcttcggcggcctgttctcttatgaccttgtggcgggatttgaaaatttaccgcaactgtcagcg gaaaatagctgccctgatttctgttttttatctcgcgatggtgattgaccatcagaaaaaaagca ctcgtattcaggccagcctgtttgctccgaatgaagaagaaaaacaacgtctcactgctcgcctgaacga actacgtcagcaactgaccgaagccgcgccgccgctgccggtggtttccgtgccgcatatgcgttgtga atgtaaccagagcgatgaagagttcggtggtgtagtgcgtttgttgcaaaaagcgattcgcgccggagaa attttccaggtggtgccatctcgcgtttctctctgccctgcccgtcaccgctggcagcctattacgtgctga aaagagtaatcccagcccgtacatgttttttatgcaggataatgatttcaccctgtttggcgcgtcgccgg aaagtcgctcaagtatgacgccaccagccgccagattgagatttaccccgattgccggaacacgtccacg cggtcgtcgtgccgatggttcgctggacagagacctcgacagccgcatcgaactggagatgcgtaccg atcataaagagctttctgaacatctgatgctggtggatctgcccgtaatgacctggcacgcgcgcgcattt gcacac ccggcagccgctacgtcgccgatctcaccaaagttgaccgttactcttacgtgatgcacctagtctcccgc gttgttggtgagctgcgccacgatctcgacgccctgcacgcttaccgcgcctgtatgaatatgggggacgtt aagcggtgcaccgaaagtacgcgctatgcagttaattgccgaagcagaaggtcgtcgacgcggcagct acggcggcgcggtaggttatttttaccgcgcatggcgatctcgacacctgcattgtgatccgctcggcgct ggtggaaaacggtatcgccaccgtgcaagccggtgctggcgtagtccttgattctgttccgcagtcggaa TABLE 86-continued Tryptophan Production Construct Sequences

| Description | Sequence |
|---|---|
| | gccgacgaaactcgtaataaagcccgcgctgtactgcgcgctattgccaccgcgcatcatgcacaggag<br>acgttctaatggctgacattctgctgctcgataatatcgactcttttacgtacaacctggcagatcagttgcg<br>cagcaatggtcataacgtggtgatttaccgcaaccatattccggcgcagaccttaattgaacgcctggcga<br>cgatgagcaatccggtgctgatgctttctcctggccccggtgtgccgagcgaagccggttgtatgccgga<br>actcctcacccgcttgcgtggcaagctgccaattattggcatttgcctcggacatcaggcgattgtcgaag<br>cttacggggcgtatgtcggtcaggcgggcgaaattcttcacggtaaagcgtcgagcattgaacatgacg<br>gtcaggcgatgtttgccggattaacaaacccgctgccagtggcgcgttatcactcgctggttggcagtaa<br>cattccggccggtttaaccatcaacgcccattttaatggcatggtgatggcggtgcgtcacgatgcagatc<br>gcgtttgtggattccagttccatccggaatccattcttactacccagggcgctcgcctgctggaacaaacg<br>ctggcctgggcgcagcagaaactagagccaaccaacacgctgcaaccgattctggaaaaactgtatca<br>ggcacagacgcttagccaacaagaaagccaccagctgttttcagcggtggtacgtggcgagctgaagc<br>cggaacaactggcggcggcgctggtgagcatgaaaattcgcggtgaacacccgaacgagatcgccgg<br>ggcagcaaccgcgctactgaaaacgccgcgccattcccgcgcccggattatctgtttgccgatatcgtc<br>ggtactggcggtgacggcagcaacagcatcaatatttctaccgccagtgcgtttgtcgccgcggcctgcg<br>ggctgaaagtggcgaaacacggcaaccgtagcgtctccagtaaatccggctcgtcggatctgctggcg<br>gcgttcggtattaatcttgatatgaacgccgataaatcgcgccaggcgctggatgagttaggcgtctgtttc<br>ctcttttcgcgccgaagtatcacaccggattccgccatgcgatgccggttcgccagcaactgaaaacccgca<br>ctctgttcaacgtgctgggaccattgattaacccggcgcatccgccgctggcgctaattggtgtttatagtc<br>cggaactggtgctgccgattgccgaaaccttgcgcgtgctggggtatcaacgcgcggcagtggtgcac<br>agcggcgggatggatgaagtttcattacacgcgccgacaatcgttgccgaactacatgacggcgaaatt<br>aagagctatcaattgaccgctgaagattttggcctgacaccgtaccaccaggagcaattggcaggcgga<br>acaccggaagaaaaccgtgacattttaacacgcttgttacaaggtaaaggcgacgccgcccatgaagca<br>gccgtcgcggcgaatgtcgccatgttaatgcgcctgcatggccatgaagatctgcaagccaatgcgcaa<br>accgttcttgaggtactgcgcagtggttccgcttacgacagagtcaccgcactggcggcacgagggtaa<br>atgatgcaaaccgttttagcgaaaatcgtcgcagacaggcgatttgggtagaaacccgcaaagagcag<br>caaccgctggccagttttcagaattgaggttcagccgagcacgccgacattttttatgatgcacttcagggcgc<br>acgcacggcgtttattctggagtgtaaaaaagcgtcgccgtcaaaaggcgtgatccgtgatgatttcgatc<br>cggcacgcattgccgccatttataaacattacgcttcggcaatttcagtgctgactgatgagaaatattca<br>gggagctttgatttcctccccatcgtcagccaaatcgcccgcagccgattttatgtaaagacttcattatc<br>gatccttaccagatctatctggcgcgctattaccaggccgatgcctgcttattaatgctttcagtactggatg<br>acgaacaatatcgccagcttgcagccgtcgcccacagtctggagatgggtgtgctgaccgaagtcagta<br>atgaagaggaactggagcgcgccattgcattgggggcaaaggtcgttggcatcaacaaccgcgatctg<br>cgcgatttgtcgattgatctcaaccgtacccgcgagcttgcgccgaaactggggcacaacgtgacggta<br>atcagcgaatccgcgcatcaatacttacgctcaggtgcgcggattaagccacttcgctaacggctttctgatt<br>ggttcggcgttgatggcccatgacgatttgaacgccgccgtgcgtcgggtgttgctgggtgagaataaag<br>tatgtggcctgacacgtgggcaagatgctaaagcagctttatgacgcgggcgcgatttacggtgggttgat<br>ttttgttgcgacatcaccgcgttgcgtcaacgttgaacaggcgcaggaagtgatggctgcagcaccgttg<br>cagtatgttggcgtgttccgcaatcacgatattgccgatgtgcggacaaagctaaggtgttatcgctggc<br>ggcagtgcaactgcatggtaatgaagatcagctgtatatcgacaatctgcgtgaggctctgccagcacac<br>gtcgccatctgtgaaggctttaagtgtcggtgaaactcttcccgcgcgcgattttcagcacatcgataaatat<br>gtattcgacaacggtcagggcgggagcggacaacgtttcgactggtcactattaaatggtcaatcgcttg<br>gcaacgttctgctggcggggggcttaggcgcagataactgcgtggaagcggcacaaaccggctgcgc<br>cgggcttgattttaattctgctgtagagtcgcaaccgggtatcaaagacgcacgtctcttttggcctcggttttc<br>cagacgctgcgcgcatattaaggaaaggaacaatgacaacattacttaaccctattttggtgagtttggc<br>ggcatgtacgtgccacaaatcctgatgcctgctctgcgccagctggaagaagcttttgtcagcgcgcaaa<br>aagatcctgaatttcaggctcagttcaacgacctgctgaaaaactatgccgggcgtcaaccgcgctgac<br>caaatgccagaacattacagccgggacgaacaccacgctgtatctgaagcgcgaagatttgctgcacgg<br>cggcgcgcataaaactaaccaggtgctcggtcaggctttactggcgaagcggatgggtaaaactgaaat<br>tattgccgaaaccggtgccggtcagcatggcgtggcgtcggcccttgccagcgccctgctcggcctgaa<br>atgccgaatttatatgggtgccaaagacgttgaacgccagtcgccaacgttttccggatgcgcttaatgg<br>gtgcggaagtgatcccggtacatagcggttccgcgacccctgaaagatgcctgtaatgaggcgctacgcg<br>actggtccggcagttatgaaaccgcgcactatatgctgggtaccgcagctggcccgcatcctacccgac<br>cattgtgcgtgagtttcagcggatgattggcgaagaaacgaaagcgcagattctggaaagagaaggtcg<br>cctgccggatgccgttatcgcctgtgttggcggtggttcgaatgccatcggtatgtttgcagatttcatcaac<br>gaaaccgacgtcggcctgattggtgtggagcctggaagccgatcgaaactggcgagcacggcg<br>caccgttaaaacatggtcgcgtgggcatctatttcggtatgaaagcgccgatgatgcaaaccgaagacg<br>ggcaaattgaagagtcttactccatttctgccgggctggatttcccgtccgtcggcccgcaacatgcgtatc<br>tcaacagcactggacgcgctgattacgtgtctattaccgacgatgaagccctggaagcctttaaaacgctt<br>tgcctgcatgaaggggatcatcccggcgctggaatcctcccacgccctggccatgcgctgaaaatgatg<br>cgcgaaaatccggaaaaagagcagctactggtggttaaccttccggtcgcggcgataaagacatcttca<br>ccgttcacgatattttgaaagcacgaggggaaatctgatggaacgctacgaatctctgtttgcccagttgaa<br>ggagcgcaaagaaggcgcattcgttcctttcgtcaccctcggtgatccgggcattgagcagtcgttgaaa<br>attatcgatacgctaattgaagccggtgctgacgcgctggagttaggcatccccttctccgacccactggc<br>ggatggcccgacgattcaaaacgccacactgcgtgctttttgcggcgggagtaaccccggcgcagtctt<br>tgagatgctggcactcattcgccagaagcacccgaccattcccatcggccttttgatgtatgccaacctgg<br>tgtttaacaaaggcattgatgagttttatgccgagtgcgagaaagtcggcgtcgattcggtgctggttgccg<br>atgtgccgtggaagagtccgcgccctccgccaggccgtgcgtcataatgtcgcacctatctttattt<br>gcccgccgaatgccgacgatgatttgctgcgccagatagcctcttacggtcgtggttacacctatttgctgt<br>cgcgagcgggcgtgaccggcgcagaaaaccgcgccgcgttacccctcaatcatctggttgcgaagctg<br>aaagagtacaacgctgcgcctccattgcagggatttggtatttccgccccggatcaggtaaaagccgcga<br>ttgatgcaggagctgcgggcgatttctggttcggccatcgttaaaatcatcgagcaacatattaatgag<br>ccagagaaaatgctggcggcactgaaagcttttgtacaaccgatgaaagcggcgacgcgcagtta |
| fbrS40FTrpE-<br>DCBA (leader<br>region and RBS | ctctagaaataattttgtttaactttaagaaggagatatacatatgcaaacacaaaaaccgactctcgaactg<br>ctaacctgcgaaggcgcttatcgcgacaacccgactgcgcttttttcaccagttgtgtggggatcgtccggc<br>aacgctgctgctggaattcgcagatatcgacagcaaagatgatttaaaaaagcctgctgctggtagacagt |

TABLE 86-continued

Tryptophan Production Construct Sequences

| Description | Sequence |
|---|---|
| underlined) SEQ ID NO: 878 | gcgctgcgcattacagcattaagtgacactgtcacaatccaggcgctaccggcaatggagaagccctgt tgacactactggataacgccagcctgcgggtgtggaaaatgaacaatcaccaaactgccgcgtactgcg cacccgcctgtcagtccactgctggatgaagacgcccgcttatgctcccatcggtattgacgctaccgct tattacagaatctgagaatgtaccgaaggaagaacgagaagcaatgacttcggcggcctgactcttatg accagtggcgggatttgaaaatttaccgcaactgtcagcggaaaatagctgccctgatactgatttatctc gctgaaacgctgatggtgattgaccatcagaaaaaaagcactcgtattcaggccagcctgatgctccgaa tgaagaagaaaaacaacgtctcactgctcgcctgaacgaactacgtcagcaactgaccgaagccgcgc cgccgctgccggtggtttccgtgccgcatatgcgttgtgaatgtaaccagagcgatgaagagttcggtgg tgtagtgcgtttgttgcaaaaagcgattcgcgccggagaaattttccaggtggtgccatctcgccgtttctct ctgccctgcccgtcaccgctggcagcctattacgtgctgaaaaagagtaatcccagcccgtacatgttttttt atgcaggataatgatttcaccctgtttggcgcgtcgccgaaagttcgctcaagtatgacgccaccagcc gccagattgagatttacccgattgccggaacacgtccacgcggtcgtcgtgccgatggttcgctggacag agacctcgacagccgcatcgaactggagatgcgtaccgatcataaagagctttctgaacatctgatgctg gtggatctcgcccgtaatgacctggcacgcatttgcacacccggcagccgctacgtcgccgatctcacc aaagttgaccgttactcttacgtgatgcacctagtctcccgcgttgttggtgagctgcgccacgatctcgac gccctgcacgcttaccgcgcctgtatgaatatggggacgttaagcggtgcaccgaaagtacgcgctatg cagttaattgccgaagcagaaggtcgtcgacgcggcagctacggcggcggtaggtattttaccgcg catggcgatctcgacacctgcattgtgatccgctcggcgctggtggaaaacggtatcgccaccgtgcaa gccggtgctggcgtagtccttgattctgttccgcagtcggaagccgacgaaactcgtaataaagcccgcg ctgtactgcgcgctattgccaccgcgcatcatgcacaggagacgttctaatggctgacattctgctgctcg ataatatcgactcttttacgtacaacctggcagatcagttgcgcagcaatggtcataacgtggtgatttaccg caaccatattccggcgcagaccttaattgaacgcctggcgacgatgagcaatccggtgctgatgctttctc ctggccccggtgtgccgagcgaagccggttgtatgccggaactcctcacccgcttgcgtggcaagctgc caattattggcatttgcctcggacatcaggcgattgtcgaagcttacgggggctatgtcggtcaggcggg cgaaattcttcacggtaaagcgtcgagcattgaacatgacggtcaggcgatgtttgccggattaacaaac ccgctgccagtggcgcgttatcactcgctggttggcagtaacattccggccggtttaaccatcaacgccc attttaatggcatggtgatggcggtgcgtcacgatgcagatcgcgtttgtggattccagttccatccggaat ccattcttactacccagggcgctcgcctgctggaacaaacgctggcctgggcgcagcagaaactagag ccaaccaacacgctgcaaccgattctggaaaaactgtatcaggcacagacgcttagccaacaagaaag ccaccagctgttttcagcggtggtacgtggcgagctgaacaactggcggcggcgctggtga gcatgaaaattcgcggtgaacacccgaacgagatcgccggggcagcaaccgcgctactggaaaacgc cgcgccattcccgcgcccggattatctgtttgccgatatcgtcggtactggcggtgacggcagcaacagc atcaatatttctaccgccagtgcgtttgtcgccgcggcctgcgggctgaaagtggcgaaacacggcaac cgtagcgtctccagtaaatccggcctgcgtcggatcgtgttttcctcttttgcgccgaagtatcacaccggatt ccgccatgcgatgccggttcgccagcaactgaaaacccgcactctgttcaacgtgctgggaccattgatt aacccggcgcatccgccgctggcgctaattggtgtttatagtccggaactggtgctgccgattgccgaaa ccttgcgcgtgctggggtatcaacgcgcgcagtggtgcacagcggcgggatggatgaagtttcattac acgcgccgacaatcgttgccgaactacatgacggcgaaattaagagctatcaattgaccgctgaagattt ggcctgacaccctaccaccaggagcaattggcaggcggaacaccggaagaaaaccgtgacatttaac acgcttgttacaaggtaaaggcgacgccgcccatgaagcagccgtcgcggcgaatgtcgccatgttaat gcgcctgcatggccatgaagatctgcaagccaatgcgcaaaccgttcttgaggtactgccgcagtggttcc gcttacgacagagtcaccgcactggcggcacgagggtaaatgatgcaaaccgttttagcgaaaatcgtc gcagacaaggcgatttgggtagaaacccgcaaagagcagcaaccgctggccagttttcagaatgaggtt cagccgagcacgcgacattttatgatgcacttcagggcgcacgcacggcgtttattctggagtgtaaaaa agcgtcgccgtcaaaaggcgtgatccgtgatgatttcgatccgcacgcattgccgccatttataaacatt acgcttcggcaatttcagtgctgactgatgagaaatattttcaggggagctttgatttcctccccatcgtcag ccaaatcgccccgcagccgatttatgtaaagacttcattatcgatcttaccagatctatctggcgcgctat taccaggccgatgcctgcttattaatgctttcagtactggatgacgaacaatatcgccagcttgcagccgtc gcccacagtctggagatgggtgtgctgaccgaagtcagtaatgaagaggaactggagcgcgccattgc attggggcaaaggtcgttggcatcaacaaccgcgatctgcgcgatttttgtcgattgatctcaaccgtaccc gcgagcttgcgccgaaactggggcacaacgtgacggtaatcagcgaatccggcatcaatacttacgctc aggtgcgcgagttaagccacttcgctaacggctttctgattggttcggcgttgatggcccatgacgatttga acgccgcctgcgtcgggtgttgctgggtgagaataaagtatgtggcctgacacgtgggcaagatgcta aagcgcttatgacgcgggcgcgatttacggtgggttgattttttgtgcgacatcaccgcgttgcgtcaac gttgaacaggcgcaggaagtgatggctgcagcaccgttgcagtatgttggcgtgttccgcaatcacgata ttgccgatgtggcggacaaagctaaggtgttatcgctggcggcagtgcaactgcatggtaatgaagatca gctgtatatcgacaatctgcgtgaggctctgccagcacacgtcgccatctggaaggctttaagtgtcggtg aaactcttcccgcgcgcgatttcagcacatcgataaatatgtattcgcaaacgtcagggcgggagcgg acaacgtttcgactggtcactattaaatggtcaatcgcttggcaacgttctgctggcggggggcttaggcg cagataactgcgtgaagcggcacaaaccggctgcgccgggcttgattttaattctgctgtagagtcgca accgggtatcaaagacgcacgtcttttggcctcggttttccagacgctgcgcgcatattaaggaaaggaa caatgacaacattacttaaccctatttggtgagtttggcgatgtgccacaaatcctgatgcctgc tctgcgccagctggaagaagcttttgtcagcgcgcaaaaagatcctgaatttcaggctcagttcaacgacc tgctgaaaaactatgccggcgtccaaccgcgctgaccaaatgccagaacattacagccgggacgaac accacgctgtatctgaagcgcgaagatttgctgcacggcggcgcgcataaaactaaccaggtgctcggt caggctttactggcgaagcggatgggtaaaactgaaattattgccgaaaccggtgccggtcagcatggc gtggcgtcggcccttgccagcgccctgctcggcctgaaatgccgaatttatatgggtgccaaagacgttg aacgccagtcgcccaacgttttccggatgcgcttaatgggtgcggaagtgatcccggtacatagcggttc cgcgaccctgaaagatgcctgtaatgaggcgctacgcgactggtccggcagttatgaaaccgcgcacta tatgctggtaccgcagccagcggcccgcatccttacccgaccattgtgcgtgagtttcagcggatgattggcg aagaaacgaaagcgcagattctgaaagagaaggtcgcctgccggatgccgttatcgcctgtgttggcg gtggttcgaatgccatcggtatgtttcagatttcatcaacgaaaccgacgtcggcctgattggtgtggag cctggcggcacaggtatcgaaactggcgagcacgcgcaccgttaaaacatggtcgcgtgggcatcta tttcggtatgaaagcgccgatgatgcaaaccgaagacgggcaaattgaagagtcttactccatttctgccg ggctggatttcccgtccgtcggcccgcaacatgcgtatctcaacagcactggacgcgctgattacgtgtct |

TABLE 86-continued

Tryptophan Production Construct Sequences

| Description | Sequence |
|---|---|
|  | attaccgacgatgaagccctggaagcctttaaaacgctttgcctgcatgaagggatcatcccggcgctgg<br>aatcctcccacgccctggcccatgcgctgaaaatgatgcgcgaaaatccggaaaaagagcagctactg<br>gtggttaaccttttccggtcgcggcgataaagacatcttcaccgttcacgatattttgaaagcacgagggga<br>aatctgatggaacgctacgaatctctgtttgcccagttgaaggagcgcaaagaaggcgcattcgttcctttc<br>gtcaccctcggtgatccgggcattgagcagtcgttgaaaattatcgatacgctaattgaagccggtgctga<br>cgcgctggagttaggcatccccttctccgacccactggcggatggcccgacgattcaaaacgccacact<br>gcgtgcttttgcggcgggagtaaccccggcgcagtgctttgagatgctggcactcattcgccagaagca<br>cccgaccattcccatcggcctttgatgtatgccaacctggtgtttaacaaaggcattgatgagtttatgcc<br>gagtgcgagaaagtcggcgtcgattcggtgctggttgccggttgccggtggaagagtccggcccttc<br>cgccaggccgcgttgcgtcataatgtcgcacctatctttatttgcccgccgaatgccgacgatgatttgctg<br>cgccagatagcctcttacggtcgtggttacacctatttgctgtcgcgagcgggcgtgaccggcgcagaaa<br>accgcgccgcgttaccccctcaatcatctggttgcgaagctgaaagagtacaacgctgcgcctccattgca<br>gggatttggtattccgccccggatcaggtaaaagccgcgattgatgcaggagctgcgggcgcgatttct<br>ggttcggccatcgttaaaatcatcgagcaacatattaatgagccagagaaaatgctggcggcactgaaag<br>cttttgtacaaccgatgaaagcggcgacgcgcagttaa |
| fbrTrpE<br>SEQ ID NO: 879 | atgcaaacacaaaaaccgactctcgaactgctaacctgcgaaggcgcttatcgcgacaacccgactgcg<br>cttttcaccagttgtgtggggatcgtccggcaacgctgctgctggaattcgcagatatcgacagcaaaga<br>tgatttaaaaagcctgctgctggtagacagtgcgctgcgcattacagcattaagtgacactgtcacaatcc<br>aggcgctttccggcaatggagaagccctgttgacactactggataacgccttgcctgcgggtgtggaaaa<br>tgaacaatcaccaaactgccgcgtactgcgcttcccgcctgtcagtccactgctggatgaagacgcccgc<br>ttatgctccctttcggtttttgacgctttccgcttattacagaatctgttgaatgtaccgaaggaagaacgaga<br>agcaatgttcttcggcggcctgttctcttatgaccttgtggcgggatttgaaaatttaccgcaactgtcagcg<br>gaaaatagctgccctgatttctgttttatctcgctgaaacgctgatggtgattgaccatcagaaaaaaagca<br>ctcgtattcaggccagcctgtttgctccgaatgaagaagaaaaacaacgtctcactgctcgcctgaacga<br>actacgtcagcaactgaccgaagccgcgccgccgctgccggtggtttccgtgccgcatatgcgttgtga<br>atgtaaccagagcgatgaagagttcggtggtgtagtgcgtttgttgcaaaaagcgattcgcgccggagaa<br>attttccaggtggtgccatctcgccgtttctctctgccctgcccgtcaccgctggcagcctattacgtgctga<br>aaaagagtaatcccagcccgtacatgtttttttatgcaggataatgatttcaccctgtttggcgcgtcgccgg<br>aaagttcgctcaagtatgacgccaccagccgccagattgagatttacccgattgccggaacacgtccacg<br>cggtcgtcgtgccgatggttcgctggacagagacctcgacagccgcatcgaactggagatgcgtaccg<br>atcataaagagctttctgaacatctgatgctggtggatctcgcccgtaatgacctggcacgcatttgcacac<br>ccggcagccgctacgtcgccgatctcaccaaagttgaccgttactcttacgtgatgcacctagtctcccgc<br>gttgttggtgagctgcgccacgatctcgacgccctgcacgcttaccgcgcctgtatgaatatggggacgtt<br>aagcggtgcaccgaaagtacgcgctatgcagttaattgccgaagcagaaggtcgtcgacgcggcagct<br>acggcggcgcggtaggttattttaccgcgcatggcgatctcgacacctgcattgtgatccgctcggcgct<br>ggtggaaaacggtatcgccaccgtgcaagccggtgctggcgtagtccttgattctgttccgcagtcggaa<br>gccgacgaaactcgtaataaagcccgcgctgtactgcgcgctattgccaccgcgcatcatgcacaggag<br>acgttcta |

In some embodiments, the Tryptophan Production Construct is at least about 80%, at least about 85%, at least about 90%, at least about 95%, or at least about 99% homologous to the sequence of SEQ ID NO: 862, SEQ ID NO: 863, SEQ ID NO: 864, SEQ ID NO: 872, SEQ ID NO: 873, SEQ ID NO: 868, SEQ ID NO: 878, SEQ ID NO: 879.

Example 31. Tryptophan Production in an Engineered Strain of *E. coli* Nissle Tryptophan production was assessed in various strains, including the effecto of feedback resistant TrpE.

First, in order to remove the negative regulation of tryptophan biosynthetic genes mediated by the transcription factor TrpR, the trpR gene was deleted form the *E. coli* Nissle genome. The tryptophan operon trpEDCBA was amplified by PCR from the *E. coli* Nissle genomic DNA and cloned in the low-copy plasmid pSC101 under the control of the tet promoter, downstream of the tetR repressor gene. This tet-trpEDCBA plasmid was then transformed into the ΔtrpR mutant to obtain the ΔtrpR, tet-trpEDCBA strain. Subsequently, a feedback resistant version of the aroG gene (aroG$^{fbr}$) from *E. coli* Nissle, coding for the enzyme catalyzing the first committing step towards aromatic amino acid production, was synthesized and cloned into the medium copy plasmid p15A, under the control of the tet promoter, downstream of the tetR repressor. This plasmid was transformed into the ΔtrpR, tet-trpEDCBA strain to obtain the ΔtrpR, tet-trpEDCBA, tet-aroG$^{fbr}$ strain. Finally, a feedback resistant version of the tet-trpEBCDA construct (tet-trpE$^{fbr}$BCDA) was generated from the tet-trpEBCDA. Both the tet-aroG$^{fbr}$ and the tet-trpE$^{fbr}$BCDA constructs were transformed into the ΔtrpR mutant to obtain the ΔtrpR, tet-trpE$^{fbr}$DCBA, tet-aroG$^{fbr}$ strain.

Figure 10A:
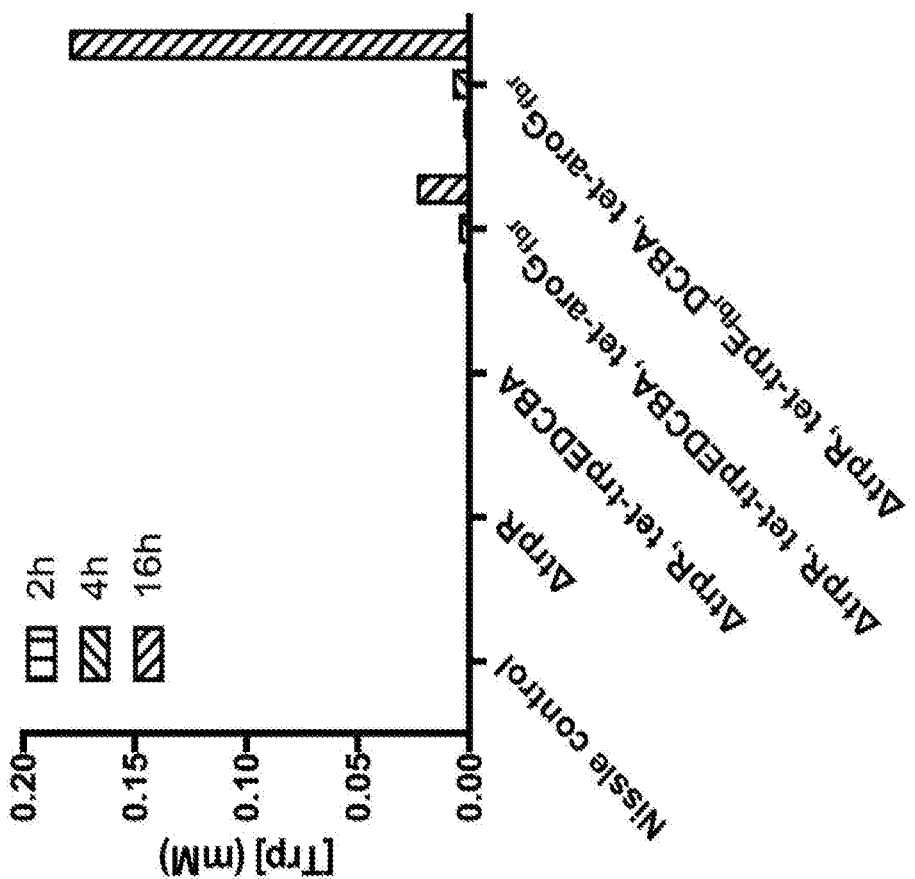
FIG. 10A, FIG. 10B, and FIG. 10C and FIG. 10D depict bar graphs showing tryptophan production by various engineered bacterial strains.

All generated strains were grown in LB overnight with the appropriate antibiotics and subcultured 1/100 in 3 mL LB with antibiotics in culture tubes. After two hours of growth at 37 C at 250 rpm, 100 ng/mL anhydrotetracycline (ATC) was added to the culture to induce expression of the constructs. Two hours after induction, the bacterial cells were pelleted by centrifugation at 4,000 rpm for 5 min and resuspended in 3 mL M9 minimal media. Cells were spun down again at 4,000 rpm for 5 min, resuspended in 3 mL M9 minimal media with 0.5% glucose and placed at 37 C at 250 rpm. 200 uL were collected at 2 h, 4 h and 16 h and tryptophan was quantified by LC-MS/MS in the bacterial supernatant. FIG. 10A shows that tryptophan is being produced and secreted by the ΔtrpR, tet-trpEDCBA, tet-aroG$^{fbr}$ strain. The production of tryptophan is significantly enhanced by expressing the feedback resistant version of trpE.

Figure 10B:
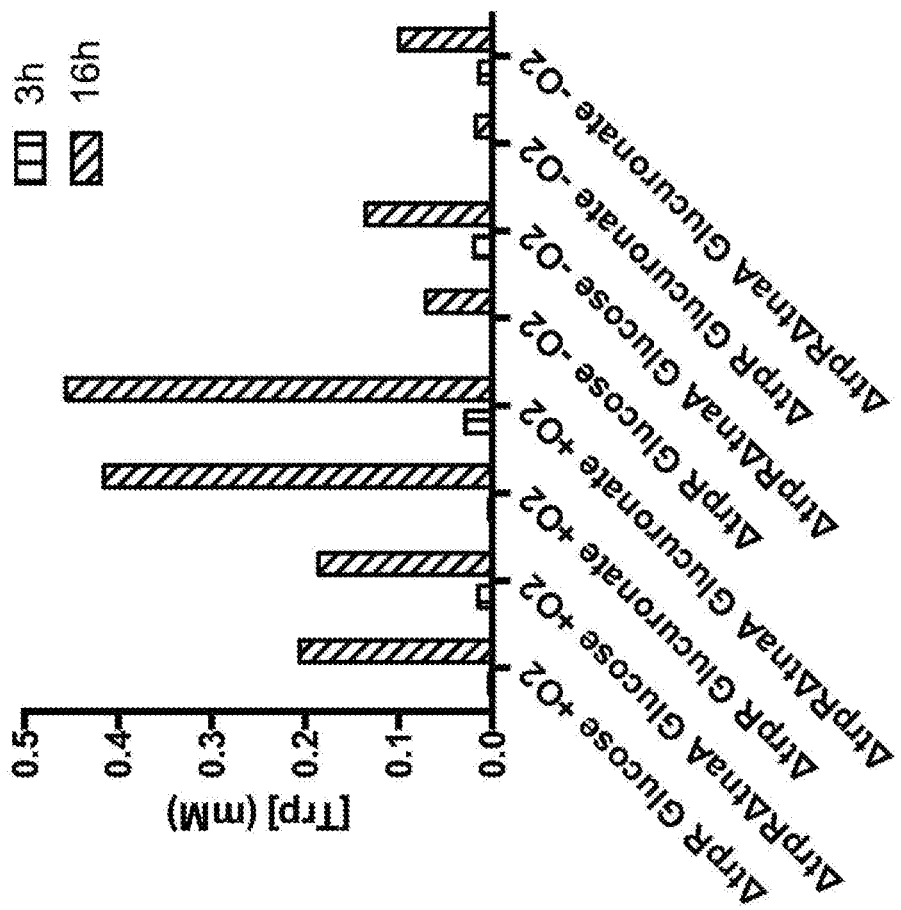

Example 32. Improved Tryptophan Production by Using a Non-PTS Carbon Source and by Deleting the tnaA Gene Encoding for the Tryptophanase Enzyme Converting Tryptophan into Indole One of the precursor molecule to tryptophan in *E. coli* is phosphoenolpyruvate (PEP). Only 3% of available PEP is normally used to produce aromatic acids (that include tryptophan, phenylalanine and tyrosine). When E. coli is grown using glucose as a sole carbon source, 50% of PEP is used to import glucose into the cell using the phosphotransferase system (PTS). In order to increase tryptophan production, a non-PTS oxidized sugar, glucuronate, was used to test tryptophan secretion by the engineered E. coli Nissle strain ΔtrpR, tet-trpE$^{fbr}$DCBA, tet-aroG$^{fbr}$. In addition, the tnaA gene, encoding the tryptophanase enzyme, was deleted in the ΔtrpR, tet-trpE$^{fbr}$DCBA, tet-aroG$^{fbr}$ strain in order to block the conversion of tryptophan into indole to obtain the ΔtrpRΔtnaA, tet-trpE$^{fbr}$DCBA, tet-aroG$^{fbr}$ strain.

the ΔtrpR, tet-trpE$^{fbr}$DCBA, tet-aroG$^{fbr}$ and ΔtrpRΔtnaA, tet-trpE$^{fbr}$DCBA, tet-aroG$^{fbr}$ strains were grown in LB overnight with the appropriate antibiotics and subcultured 1/100 in 3 mL LB with antibiotics in culture tubes. After two hours of growth at 37 C at 250 rpm, 100 ng/mL anhydrotetracycline (ATC) was added to the culture to induce expression of the constructs. Two hours after induction, the bacterial cells were pelleted by centrifugation at 4,000 rpm for 5 min and resuspended in 3 mL M9 minimal media. Cells were spun down again at 4,000 rpm for 5 min, resuspended in 3 mL M9 minimal media with 1% glucose or 1% glucuronate and placed at 37 C at 250 rpm or at 37 C in an anaerobic chamber. 200 uL were collected at 3 h and 16 h and tryptophan was quantified by LC-MS/MS in the bacterial supernatant. FIG. 10B shows that tryptophan production is doubled in aerobic condition when the non-PTS oxidized sugar glucoronate was used. In addition, the deletion of tnaA had a positive effect on tryptophan production at the 3 h time point in both aerobic and anaerobic conditions and at the 16 h time point, only in anaerobic condition.

Figure 10C:
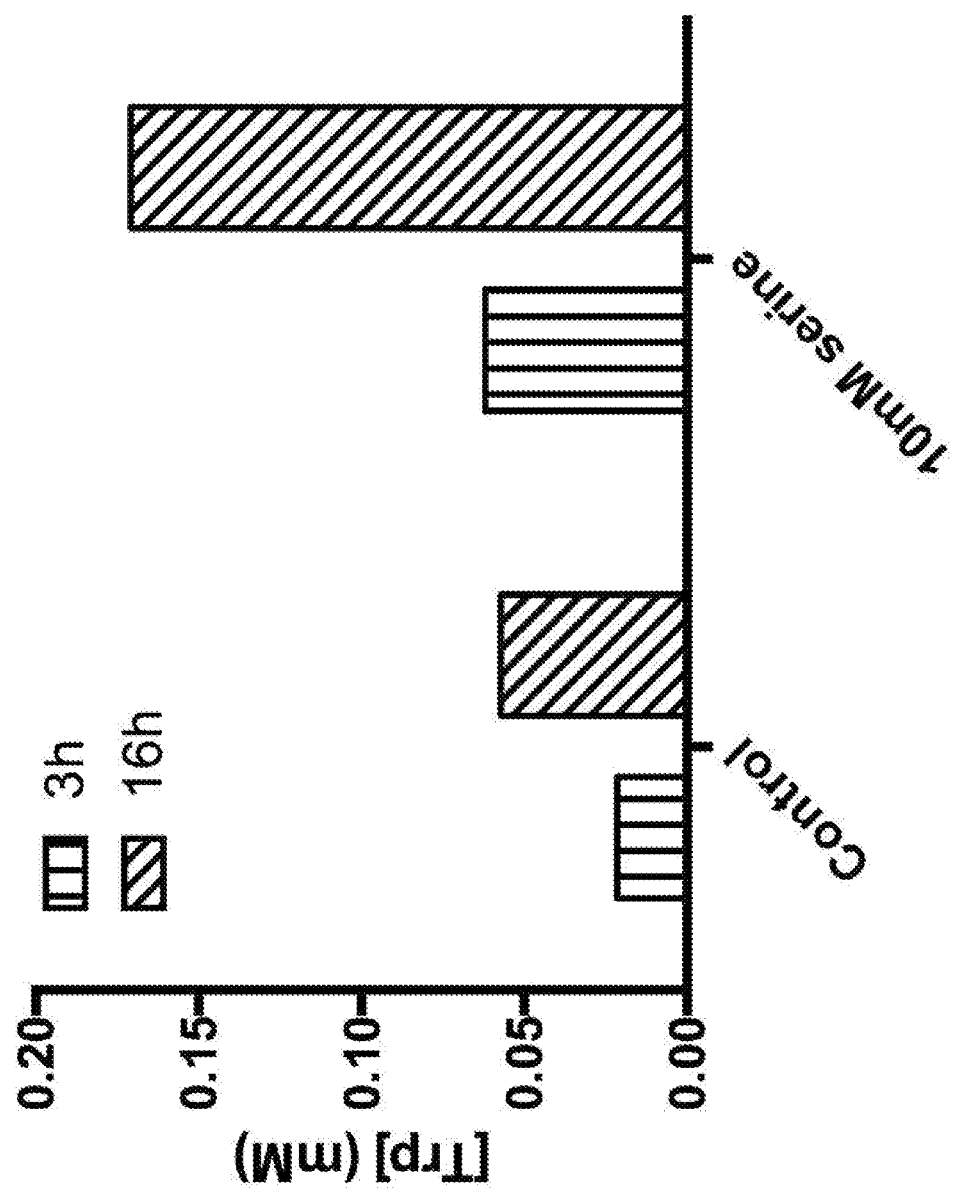

Example 33. Improved Tryptophan Production by Increasing the Rate of Serine Biosynthesis in E. coli Nissle and Comparison of Various Tryptophan Producing Strains Improved Tryptophan Production by Increasing the Rate of Serine Biosynthesis in E. coli Nissle The last step in the tryptophan biosynthesis in E. coli consumes one molecule of serine. In this example, we demonstrate that serine availability is a limiting factor for tryptophan production and describe the construction of the tryptophan producing E. coli Nissle strains ΔtrpRΔtnaA, tet-trpE$^{fbr}$DCBA, tet-aroG$^{fbr}$ serA and ΔtrpRΔtnaA, tet-trpE$^{fbr}$DCBA, tet-aroG$^{fbr}$ serA$^{fbr}$ strains.

the ΔtrpRΔtnaA, tet-trpE$^{fbr}$DCBA, tet-aroG$^{fbr}$ strain was grown in LB overnight with the appropriate antibiotics and subcultured 1/100 in 3 mL LB with antibiotics in culture tubes. After two hours of growth at 37 C at 250 rpm, 100 ng/mL anhydrotetracycline (ATC) was added to the culture to induce expression of the constructs. Two hours after induction, the bacterial cells were pelleted by centrifugation at 4,000 rpm for 5 min and resuspended in 3 mL M9 minimal media. Cells were spun down again at 4,000 rpm for 5 min, resuspended in 3 mL M9 minimal media with 1% glucuronate or 1% glucuronate and 10 mM serine and placed at 37 C an anaerobic chamber. 200 uL were collected at 3 h and 16 h and tryptophan was quantified by LC-MS/MS in the bacterial supernatant. FIG. 10C shows that tryptophan production is improved three fold by serine addition.

In order to increase the rate of serine biosynthesis in the ΔtrpRΔtnaA, tet-trpE$^{fbr}$DCBA, tet-aroG$^{fbr}$ strain, the serA gene from E. coli Nissle encoding the enzyme catalyzing the first step in the serine biosynthetic pathway was amplified by PCR and cloned into the tet-aroG$^{fbr}$ plasmid by Gibson assembly. The newly generated tet-aroG$^{fbr}$-serA construct was then transformed into a ΔtrpRΔtnaA, tet-trpE$^{fbr}$DCBA strain to generate the ΔtrpRΔtnaA, tet-trpE$^{fbr}$DCBA, tet-aroG$^{fbr}$-serA strain. The tet-aroG$^{fbr}$-serA construct was further modified to encode a feedback resistant version of serA (serA$^{fbr}$). The newly generated tet-aroG$^{fbr}$-serA$^{fbr}$ construct was used to produce the ΔtrpRΔtnaA, tet-trpE$^{fbr}$DCBA, tet-aroG$^{fbr}$-serA$^{fbr}$ strain, optimized to improve the rate of serine biosynthesis and maximize tryptophan production.

Comparison of Various Tryptophan Producing Strains

Compare the rates of tryptophan production in the different strains generated, the following constructs and strains were generated according to methods and sequences described herein, and assayed for tryptophan production in the presence of glucuronate as a carbon source under aerobic conditions. SYN2126 comprises ΔtrpRΔtnaA (ΔtrpRΔtnaA). SYN2323 comprises ΔtrpRΔtnaA and a tetracycline inducible construct for the expression of feedback resistant aroG on a plasmid (ΔtrpRΔtnaA, tet-aroGfbr). SYN2339 comprises ΔtrpRΔtnaA and a first tetracycline inducible construct for the expression of feedback resistant aroG on a first plasmid and a second tetracycline inducible construct with the genes of the trp operon with a feedback resistant form of trpE on a second plasmid (ΔtrpRΔtnaA, tet-aroGfbr, tet-trpEfbrDCBA). SYN2473 comprises ΔtrpRΔtnaA and a first tetracycline inducible construct for the expression of feedback resistant aroG and SerA on a first plasmid and a second tetracycline inducible construct with the genes of the trp operon with a feedback resistant form of trpE on a second plasmid (ΔtrpRΔtnaA, tet-aroGfbr-serA, tet-trpEfbrDCBA). SYN2476 comprises ΔtrpRΔtnaA and a tetracycline inducible construct with the genes of the trp operon with a feedback resistant form of trpE on a plasmid (ΔtrpRΔtnaA, tet-trpEfbrDCBA).

Figure 10D:
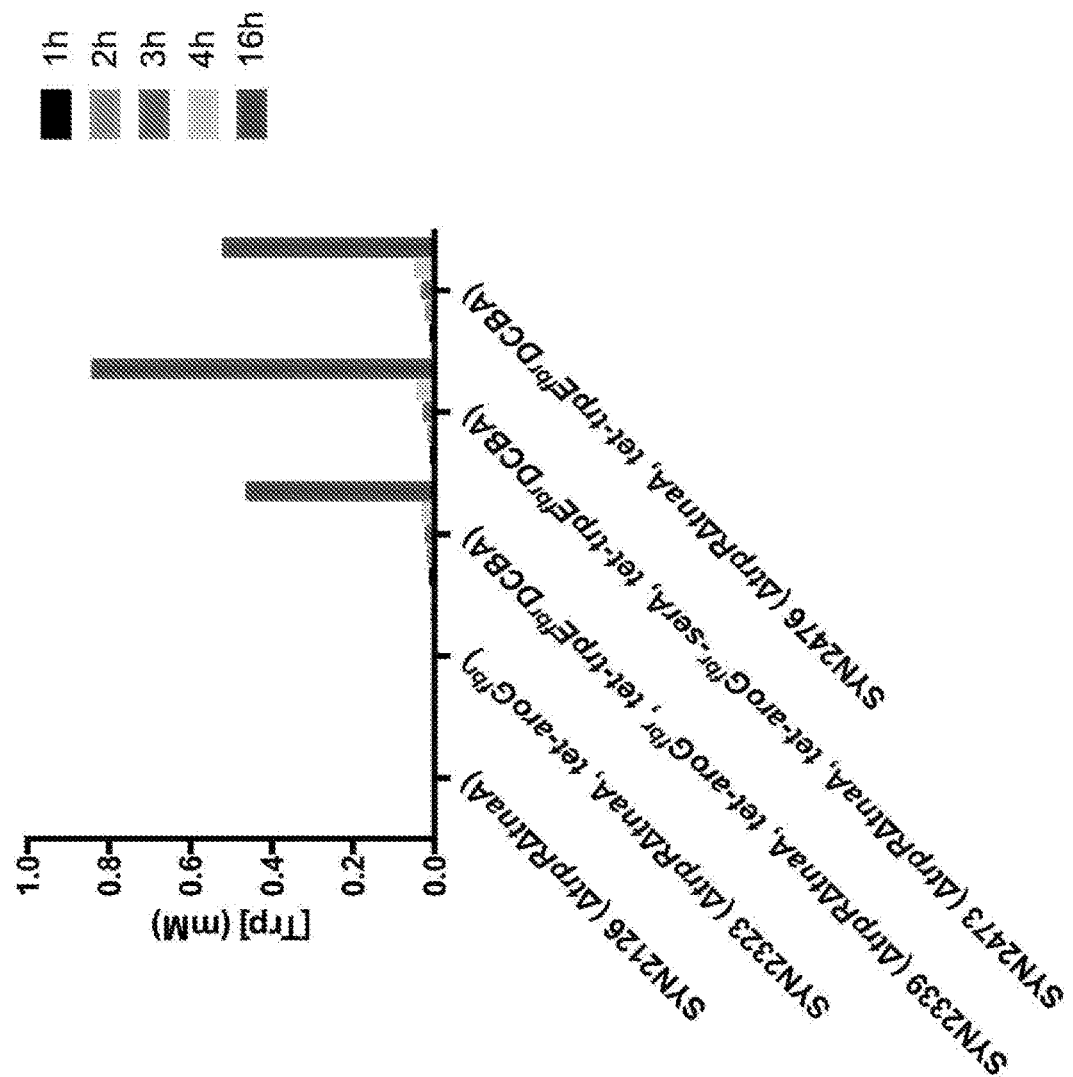
Figure 11A:
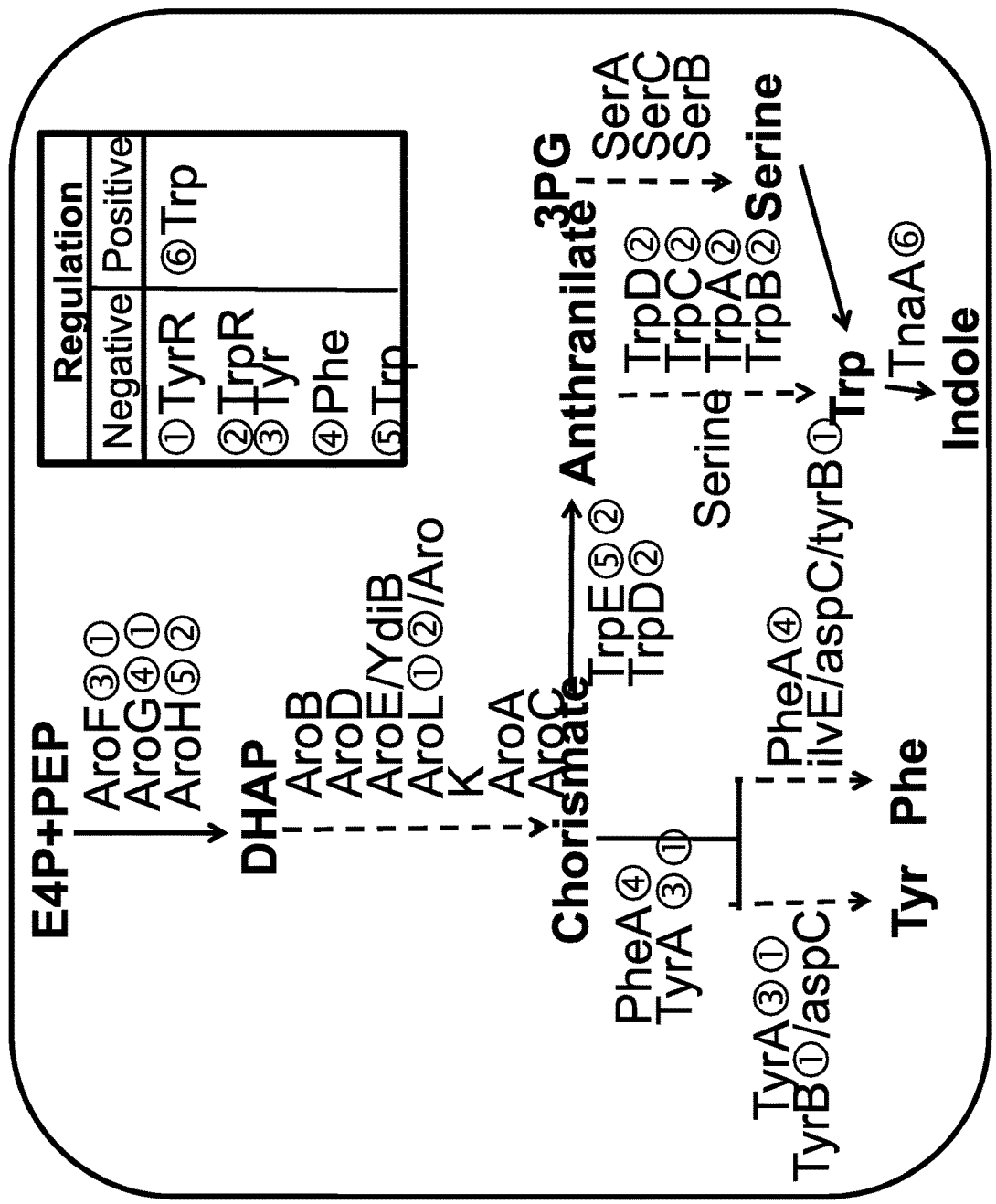
FIG. 11A and FIG. 11B depict schematics showing exemplary engineering strategies which can be employed for tryptophan production.
Figure 11B:
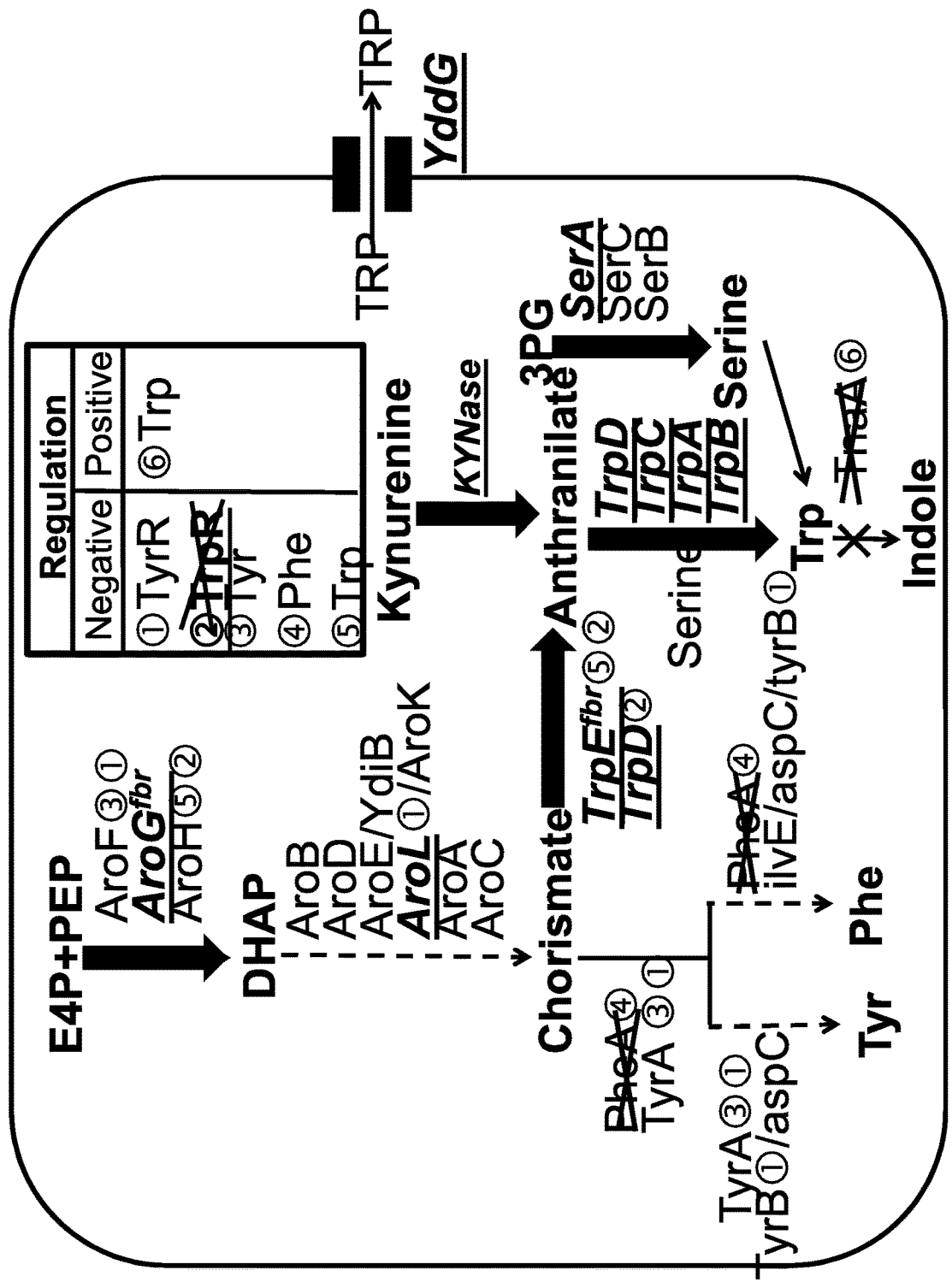
Figure 12A:
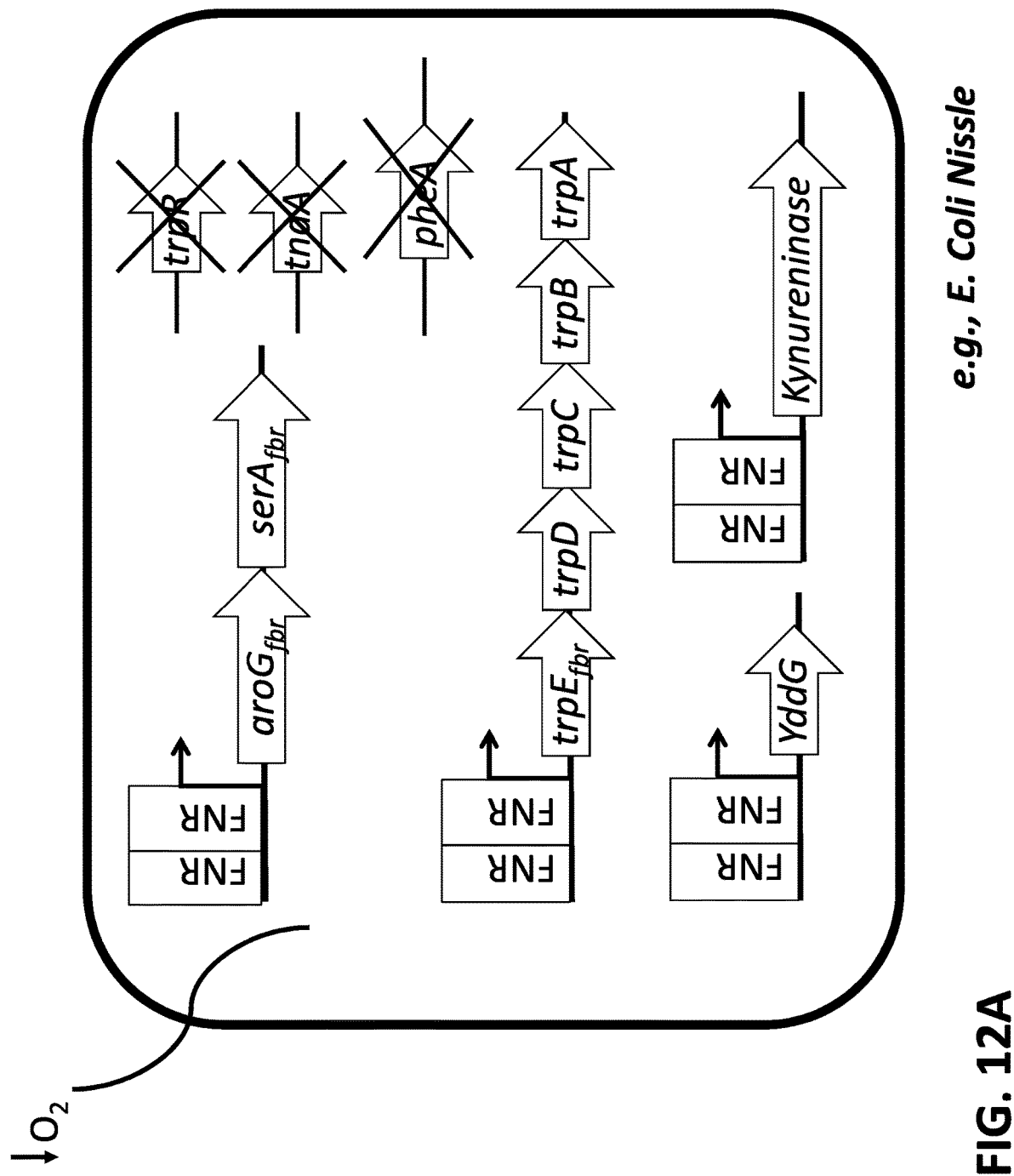
FIG. 12A and FIG. 12B depict schematics of exemplary embodiments of the disclosure, in which the genetically engineered bacteria comprise circuits for the production of tryptophan and the degradation of kynurenine. Such gene sequences can be located on a plasmid in the microorganism or can be integrated into the chromosome. In certain embodiments, the one or more gene sequences are under the control of inducible promoters known in the art or described herein. For example, such inducible promoters may be induced under low-oxygen conditions, such as an FNR promoter (depicted). In other embodiments, the promoters are induced in the presence of certain molecules or metabolites, e.g., in the presence of molecules or metabolites associated with the tumor microenvironment and/or with immune suppression. In some embodiments, the promoters are induced in certain tissue types. In some embodiments, promoters are induced in the presence of certain gut-specific molecules or metabolites. In some embodiments, the promoters are induced in the presence of some other metabolite that may or may not be present in the gut or the tumor, such as arabinose or another chemical or nutritional inducer known in the art or described herein. In certain embodiments, the one or more cassettes are under the control of constitutive promoters described herein or known in the art, e.g, whose expression can be fine-tuned using ribosome binding sites of different strengths. Such microorganisms optionally also comprise an auxotrophy, e.g., deltaThyA or deltaDapA. The bacteria may comprise any of the transporters and/or tryptophan circuits depicted and described in FIG. 8A and/or and/or FIG. 8B, and/or FIG. 8C, and/or FIG. 8D for the production of tryptophan. In one embodiment, the tryptophan is produced from the chorismate precursor through expression of the trpE, trpG-D, trpC-F, trpB and trpA genes. Optionally, Trp Repressor and/or the tnaA gene (encoding a tryptophanase converting tryptophan into indole) are deleted to further increase levels of tryptophan produced. Additionally, AroG and TrpE are replaced with feedback resistant versions to improve tryptophan production, and the strain further optionally comprises either a wild type or a feedback resistant serA gene. The bacteria may also optionally include gene sequence(s) for the expression of YddG to assist in tryptophan export. Additionally, the bacteria further comprise kynureninase, e.g., kynureninase from *Pseudomonas fluorescens*. When extracellular kynurenine is present, it is imported into the cell and is then converted by kynureninase into anthranilate. Anthranilate is then metabolized into tryptophan via the TrpDCAB pathway enzymes, resulting in further increased levels of tryptophan production.
Figure 12B:
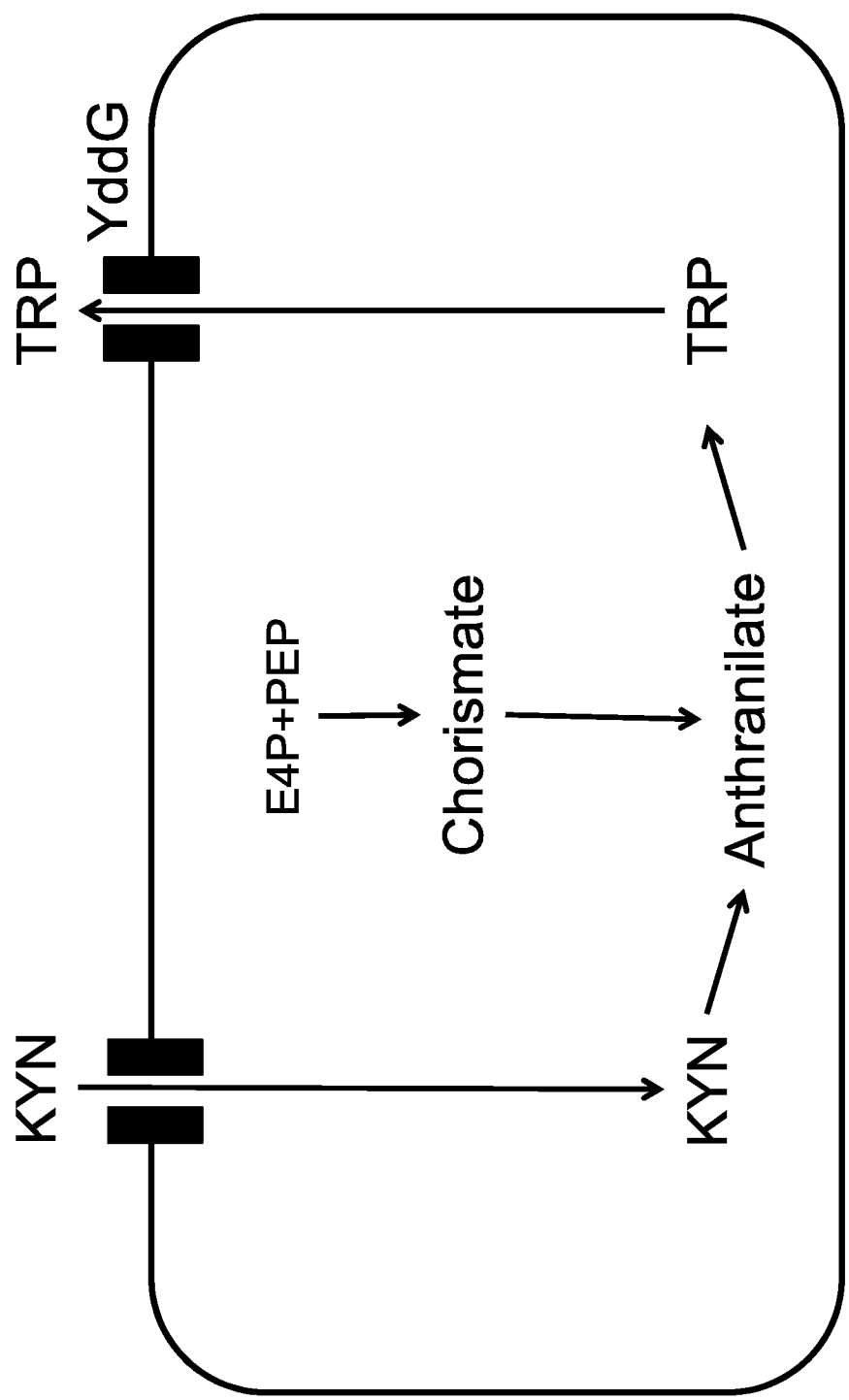
Figure 13:
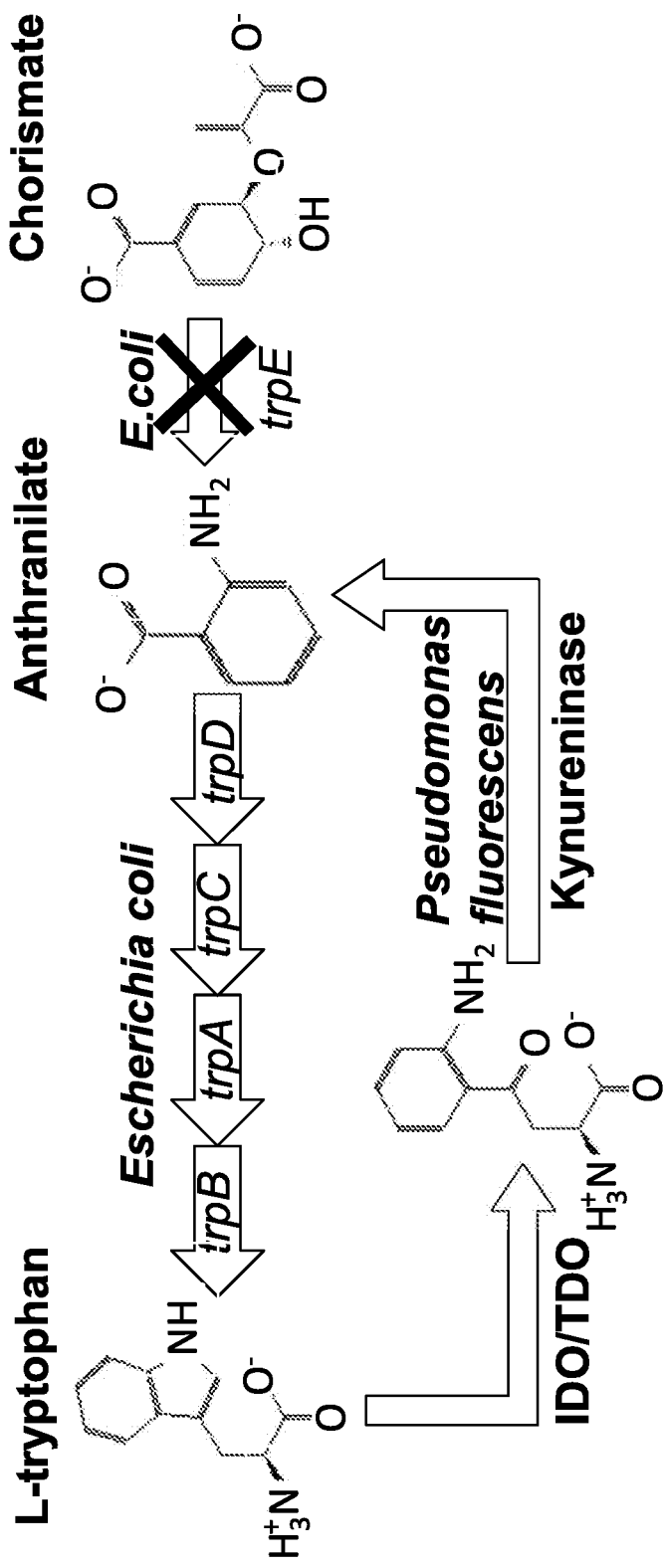
FIG. 13 depicts a schematic of one embodiment of the disclosure. In this embodiment, tryptophan is synthesized from kynurenine. Through this conversion, a immune-suppressive metabolite (kynurenine) can be removed from the external environment, e.g., a tumor environment, and a pro-inflammatory metabolite (tryptophan) is generated. Kynureninase from *Pseudomonas fluorescens* converts KYN to AA (Anthranillic acid), which then can be converted to tryptophan through the enzymes of the *E. coli* trp operon. Optionally, the trpE gene may be deleted as it is not needed for the generation of tryptophan from kynurenine. In alternate embodiments, the trpE gene is not deleted, in order to maximize tryptophan production by using both kynurenine and chorismate as a substrate. In one embodiment of the invention, the genetically engineered bacteria comprising this circuit may be useful for reducing immune escape in cancer.

Overnight cultures were diluted 1/100 in 3 mL LB plus antibiotics and grown for 2 hours (37 C, 250 rpm). Next, cells were induced with 100 ng/mL ATC for 2 hours (37 C, 250 rpm), spun down, washed with cmL M9, spun down again and resuspended in 3 mL M9+1% glucuronate. Cells were plated for CFU counting. For the assay, the cells were placed of 37 C with shaking at 250 rpm. Supernatants were collected at 1 h, 2 h, 3 h, 4 h 16 h for HPLC analysis for tryptophan. As seen in FIG. 10D, results indicate that expressing aroG is not sufficient nor necessary under these conditions to get Trp production and that expressing serA is beneficial for tryptophan production.

Example 34. Tryptophan and Anthranilic Acid Quantification in Bacterial Supernatant by LC-MS/MS Sample Preparation Tryptophan and Anthranilic acid stock (10 mg/mL) were prepared in 0.5N HCl and aliquoted in 1.5 mL microcentrifuge tubes (100 μL). Standards (250, 100, 20, 4, 0.8, 0.16, 0.032 μg/mL) of each were prepared in water. Sample (10 μL) (and standards) were mixed with 90 μL of ACN/H$_2$O (60:30, v/v) containing 1 μg/mL of Tryptophan-d5 in the final solution in a V-bottom 96-well plate. The plate was heat-sealed with a AlumASeal foil, mixed well, and centrifuged at 4000 rpm for 5 min. 10 μL of the solution was transferred into a round-bottom 96-well plate and 90 uL 0.1% formic acid in water was added to the sample. The plate was heat-sealed with a ClearASeal sheet and mixed well.

LC-MS/MS Method

Tryptophan and Anthranilic acid were measured by liquid chromatography coupled to tandem mass spectrometry (LC-MS/MS) using a Thermo TSQ Quantum Max triple quadrupole mass spectrometer. Table 87 Table 88, and Table 89 provide the summary of the LC-MS/MS method.

TABLE 87

LC-MS/MS Method

| | |
|---|---|
| Column: | Accucore aQ column, 2.6 µm (100 × 2.1 mm) |
| Mobile Phase A: | 99.9% H2O, 0.1% Formic Acid |
| Mobile Phase B: | 99.9% ACN, 0.1% Formic Acid |
| Injection volume: | 10 uL |

TABLE 88

HPLC Method

| Time (min) | Flow Rate (µL/min) | A % | B % |
|---|---|---|---|
| −0.5 | 350 | 100 | 0 |
| 0.5 | 350 | 100 | 0 |
| 1.0 | 350 | 10 | 90 |
| 2.5 | 350 | 10 | 90 |
| 2.51 | 350 | 100 | 10 |

TABLE 89

Tandem Mass Spectrometry

| | |
|---|---|
| Ion Source: | HESI-II |
| Polarity: | Positive |
| SRM transitions: | |
| Tryptophan: | 205.1/118.2 |
| Anthranilic acid: | 138.1/92.2 |
| Tryptophan-d5: | 210.1/151.1 |

Example 35. Tryptophan and Anthranilic Acid Quantification in Tumor Tissue by LC-MS/MS Sample Preparation Tryptophan and Anthranilic acid stock (10 mg/mL) were prepared in 0.5N HCl and aliquoted in 1.5 mL microcentrifuge tubes (100 µL). Standards (100, 20, 4, 0.8, 0.16, 0.032, 0.0064 µg/mL) of each were prepared in water. Weighed tumor tissues were homogenized with PBS in BeadBug prefilled tubes using a FastPrep homogenizer. The homogenate was transferred into a V-bottom 96-well plate and centrifuged at 4000 rpm for 10 min. 40 µL of sample (and standards) was mixed with 60 µL of ACN containing 1 µg/mL of Tryptophan-d5 in the final solution in a V-bottom 96-well plate. The plate was heat-sealed with a AlumASeal foil, mixed well, and centrifuged at 4000 rpm for 10 min. 10 µL of the solution was transferred into a round-bottom 96-well plate, and 90 uL 0.1% formic acid in water was added to the sample. The plate was heat-sealed with a ClearASeal sheet and mixed well.

LC-MS/MS Method

Tryptophan and Anthranilic acid were measured by liquid chromatography coupled to tandem mass spectrometry (LC-MS/MS) using a Thermo TSQ Quantum Max triple quadrupole mass spectrometer. Table 90, Table 91, and Table 92 provide the summary of the LC-MS/MS method.

TABLE 90

LC-MS/MS Method

| | |
|---|---|
| Column: | Accucore aQ column, 2.6 µm (100 × 2.1 mm) |
| Mobile Phase A: | 99.9% H2O, 0.1% Formic Acid |
| Mobile Phase B: | 99.9% ACN, 0.1% Formic Acid |
| Injection volume: | 10 uL |

TABLE 91

HPLC Method

| Time (min) | Flow Rate (µL/min) | A % | B % |
|---|---|---|---|
| −0.5 | 350 | 100 | 0 |
| 0.5 | 350 | 100 | 0 |
| 1.0 | 350 | 10 | 90 |
| 2.5 | 350 | 10 | 90 |
| 2.51 | 350 | 100 | 10 |

TABLE 92

Tandem Mass Spectrometry

| | |
|---|---|
| Ion Source: | HESI-II |
| Polarity: | Positive |
| SRM transitions: | |
| Tryptophan: | 205.1/118.2 |
| Anthranilic acid: | 138.1/92.2 |
| Tryptophan-d5: | 210.1/151.1 |

Example 36. Generation of *E. coli* Mutants with Enhanced Ability to Consume L-Kynurenine and Produce Tryptophan from Kynurenine Adaptive Laboratory Evolution was used to produce mutant bacterial strains with improved kynurenine consumption and reduced tryptophan uptake.

Prior to evolving the strains, a lower limit of kynurenine (KYN) concentration was established for use in the ALE experiment.

While lowering the KYN concentration can select for mutants capable of increasing KYN utilization, the bacterial cells still prefer to utilize free, exogenous TRP. In the tumor environment, dual-therapeutic functions can be provided by depletion of KYN and increasing local concentrations of TRP. Therefore, to evolve a strain which prefers KYN over TRP, a toxic analogue of TRP—5-fluoro-L-tryptophan (Tox-TRP)—can be incorporated into the ALE experiment.

A checkerboard growth assay was performed in 96-well plates using streptomycin resistant Nissle, deltatrpE and deltatrpE pseudoKYNase with and without induction of pseudoKYNase expression using 100 ng/uL aTc. Detailed procedures used for the checkerboard assay are described in Example 14. Strains were inoculated at very dilute concentrations into M9 minimal media with varying concentrations of KYN across columns (2-fold dilutions starting at 2000 ug/mL) and varying concentrations of ToxTrp across rows (2-fold dilutions starting at 200 ug/mL). On a separate plate, the strains were grown in M9+KYN (at the same concentrations) in the absence of ToxTrp.

Figure 14:
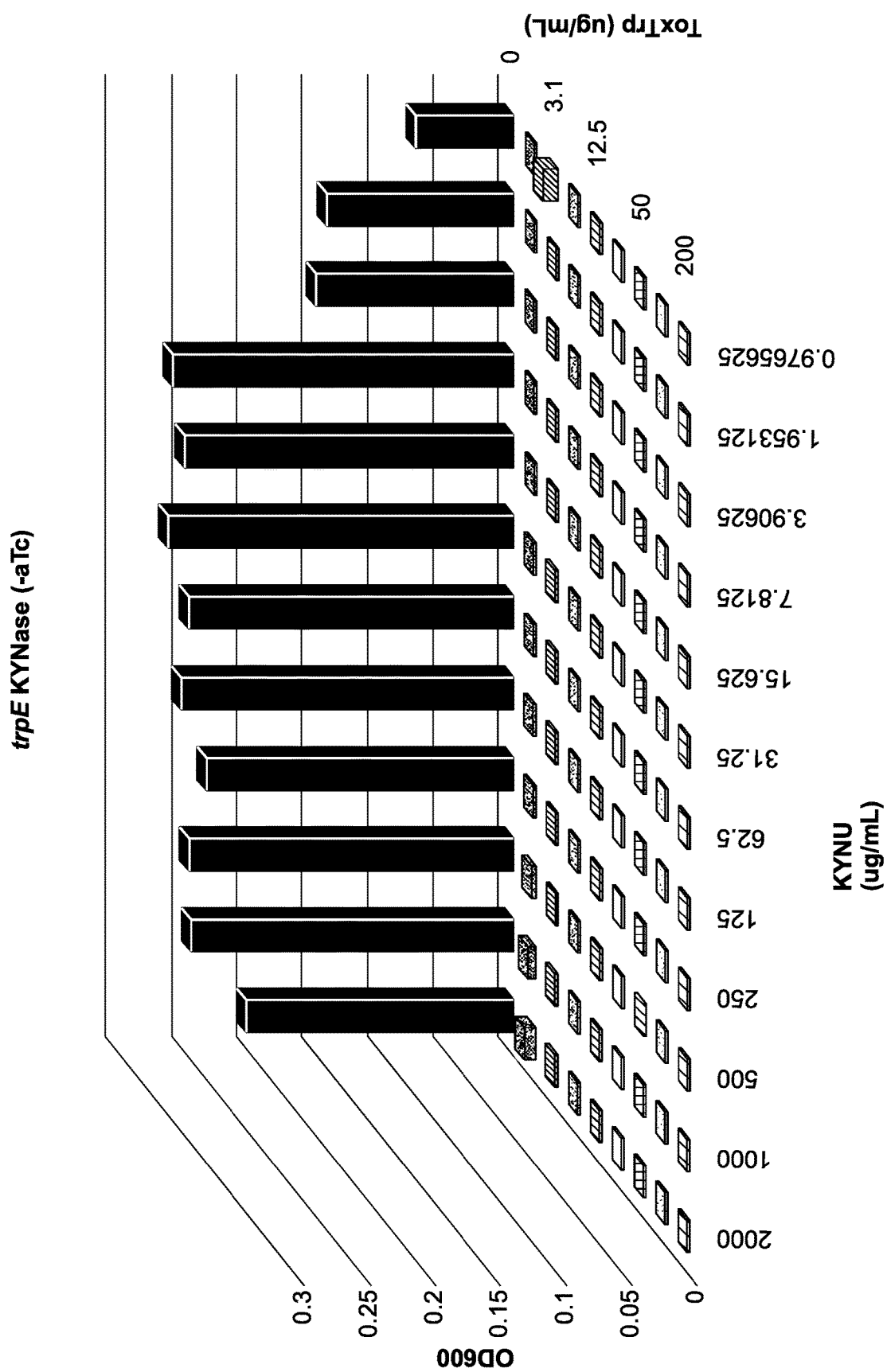
FIG. 14 depicts a bar graph which shows the results of a checkerboard assay to establish the concentrations of kynurenine and 5-fluoro-L-tryptophan (ToxTrp) capable of sustaining growth of a trpE mutant of *E. coli* Nissle expressing pseudoKYNase. Bacteria were grown in the presence of different concentrations of KYNU and ToxTrp, and in the absence of Anhydrous Tetracycline (aTc). Growth was assessed at OD600.
Figure 15:
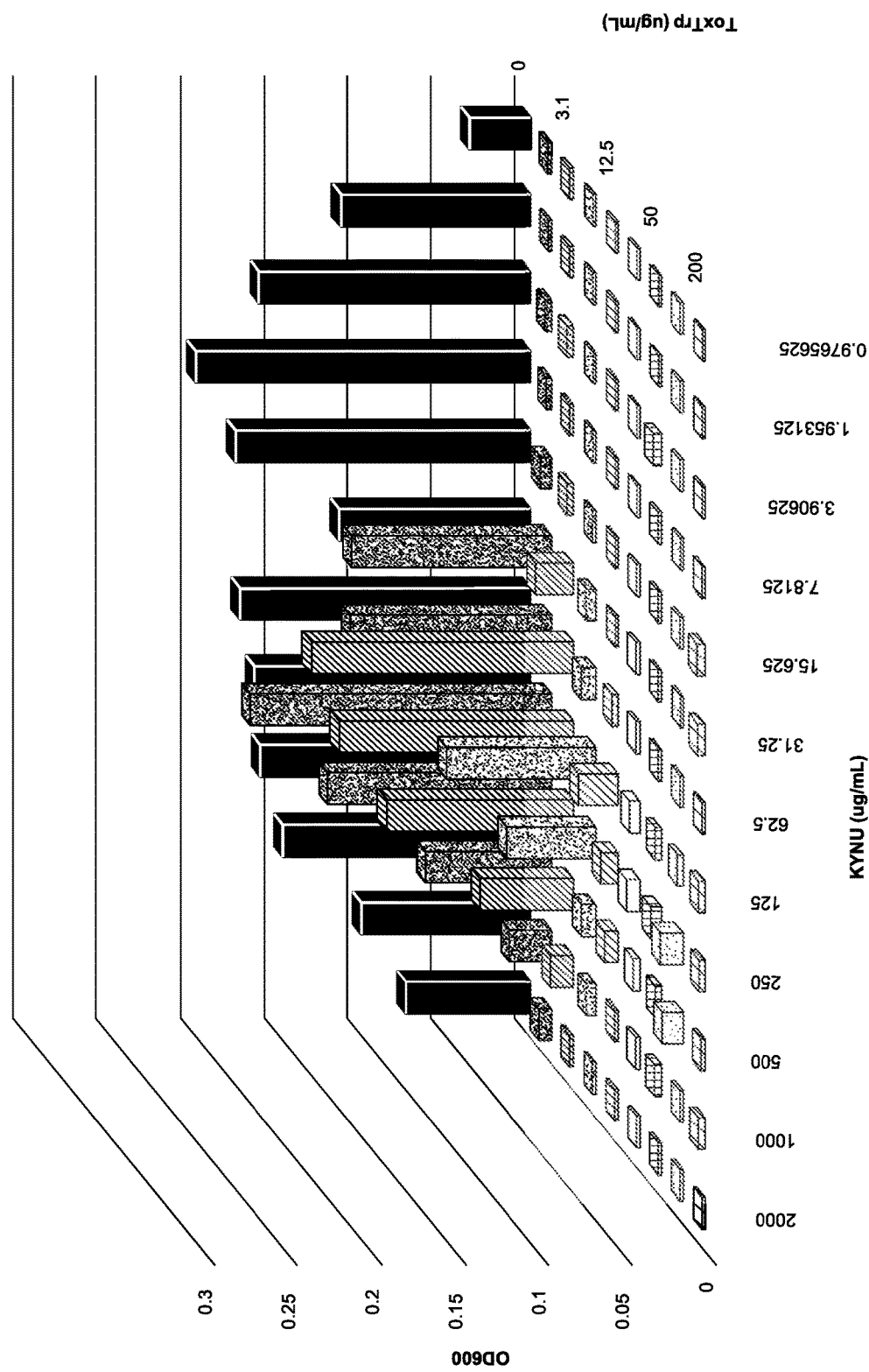
FIG. 15 depicts a bar graph which shows the results of a checkerboard assay to establish the concentrations of kynurenine and 5-fluoro-L-tryptophan (ToxTrp) capable of sustaining growth of a trpE mutant of *E. coli* Nissle expressing pseudoKYNase. Bacteria were grown in the presence of different concentrations of KYNU and ToxTrp, and in the presence of Anhydrous Tetracycline (aTc). Growth was assessed at OD600.
Figure 16:
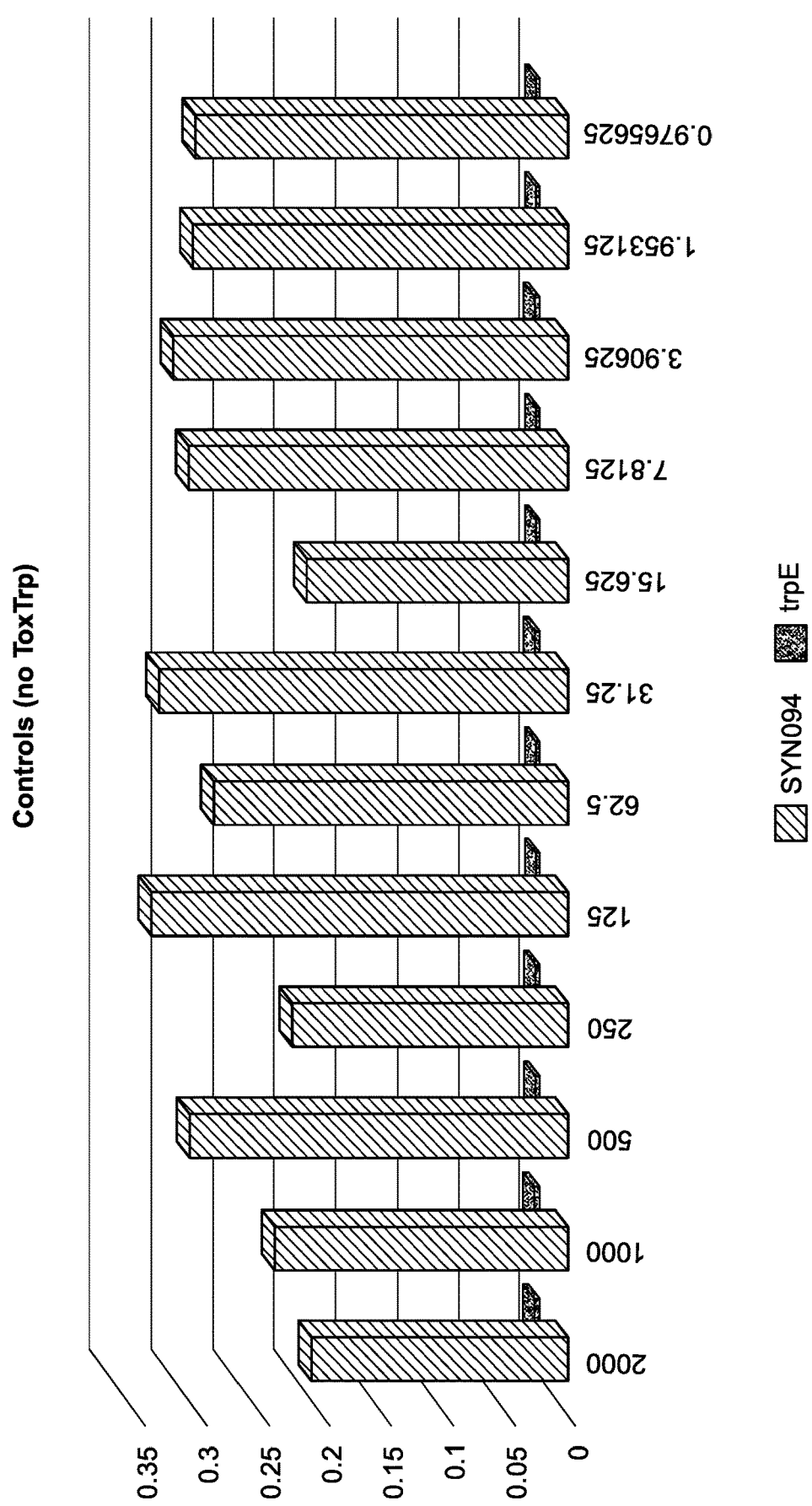
FIG. 16 depicts a bar graph which shows the growth of the wild-type *E. coli* Nissle (SYN094) and a control strain in which trpE is knocked out in M9+KYNU, without ToxTrp.

The results of the initial checkerboard assay are shown in FIG. 14, FIG. 15, and FIG. 16 as a function of optical density at 600 nm (normalized to a media blank). In FIG. 14 and FIG. 15, the X-axis shows decreasing KYNU concentration from left-to-right, while the Z-axis shows decreasing ToxTrp concentration from front-to-back with the very back row representing media with no ToxTrp. In FIG. 16, the controls and trpE strains are shown in M9+KYNU without any ToxTrp, as there was no growth detected from either strain at any concentration of ToxTrp. The results of the assay show that expression of the pseudoKYNase provides protection against toxicity of ToxTrp. More importantly, growth is permitted between 250-62.5 ug/mL of KYNU and 6.3-1.55 ug/mL of ToxTrp.

Example 37. Checkerboard Assay and ALE Parameters

To establish the minimum concentration of L-kynurenine and maximum concentration of 5-fluoro-L-tryptophan (ToxTrp) capable of sustaining growth of the KYNase strain, using a checkerboard assay, the following protocol was used. Using a 96-well plate with M9 minimal media with glucose, KYN was supplemented decreasing across columns in 2-fold dilutions from 2000 ug/mL down to ~1 ug/mL. In the rows, ToxTrp concentration decreased by 2-fold from 200 ug/mL down to ~1.5 ug/mL. In one plate, Anhydrous Tetracycline (aTc) was added to a final concentration of 100 ng/uL to induce production of the KYNase. From an overnight culture, cells were diluted to an OD600=0.5 in 12 mL of TB (plus appropriate antibiotics and inducers, where applicable) and grown for 4 hours. 100 uL of cells were spun down and resuspended to an OD600=1.0. These were diluted 2000-fold and 25 uL was added to each well to bring the final volumes in each well to 100 uL. Cells were grown for roughly 20 hours with static incubation at 37 C then growth was assessed by OD600, making sure readings fell within linear range (0.05-1.0).

Example 38. Determination of ALE Parameters

Once identified, the highest concentrations of ToxTrp and lowest concentration of kynurenine capable of supporting growth becomes the starting point for ALE. The ALE parental strain was chosen by culturing the KYNase strain on M9 minimal media supplemented with glucose and L-kynurenine (referred to as M9+KYN from here on). A single colony was selected, resuspended in 20 uL of sterile phosphate-buffered saline solution. This colony was then used to inoculate three cultures of M9+KYN, grown into late-logarithmic phase and optical density determined at 600 nm. These cultures were then diluted to $10^3$ in 4 rows of a 96-well deep-well plate with 1 mL of M9+KYN. Each one of the four rows has a different ToxTrp (increasing 2-fold), while each column has decreasing concentrations of KYN (by 2-fold). Each morning and evening this plate is diluted back to $10^3$ using the well in which the culture has grown to just below saturation so that the culture is always in logarithmic growth. This process is repeated until a change in growth rate is no longer detected. Once no growth rate increases are detected (usually around 10" Cumulative Cell Divisions) the culture is plated onto M9+KYN (Lee, et al., Cumulative Number of Cell Divisions as a Meaningful Timescale for Adaptive Laboratory Evolution of *Escherichia coli*. PLoS ONE 6, e26172; 2011). Individual colonies are selected and screened in M9+KYN+ToxTrp media to confirm increased growth rate phenotype. Once mutants with significantly increased growth rate on M9+KYN are isolated, genomic DNA can be isolated and sent for whole genome sequencing to reveal the mutations responsible for phenotype. All culturing is done shaking at 350 RPM at 37° C.

The resulting best performing strain can them be whole genome sequenced in order to deconvolute the contributing mutations. In some embodiments, Lambda-RED can be performed in order to reintroduce TrpE, to inactivate Trp regulation (trpR, tyrR, transcriptional attenuators) to upregulate TrpABCDE expression and increase chorismate production. The resulting strain prefers external KYN over to external TRP, efficiently converts KYN into TRP, and also now overproduces TRP.

Example 39. ALE

First, strains were generated, which comprise the trpE knock out and integrated constructs for the expression of *Pseudomonas fluorescens* KYNase driven by a constitutive promoter (Table 93). KYNase constructs were integrated at the HA3/4 site, and two different promoters were used; the promoter of the endogenous lpp gene was used in parental strain SYN2027 (HA3/4::Plpp-pKYNase KanR TrpE::CmR) and the synthetic pSynJ23119 was used in parental strain SYN2028 (HA3/4::PSynJ23119-pKYNase KanR TrpE::CmR). These strains were generated so that a strain would be evolved, which would comprise a chromosomally integrated version of *Pseudomonas fluorescens* KYNase.

TABLE 93

Constructs for Constitutive Expression of *Pseudomonas fluorescens* Kynureninase

| Description | Sequence | SEQ ID NO |
|---|---|---|
| SYN23119 promoter SEQ ID NO: 888 RBS | GGAAAATTTTTTAAAAAAAAACTTGACAGCT AGCTCAGTCCTTGGTATAATGCTAGCACGAA TTATATAAAAGTGGGAGGTGCCCGA | |
| SYN23119 promoter with RBS SEQ ID NO: 889 | GGAAAATTTTTTAAAAAAAAACTTGACAGCT AGCTCAGTCCTTGGTATAATGCTAGCACGAAGT GAATTATATAAAAGTGGGAGGTGCCCGA | |
| *Pseudomonas fluorescens*, codon optimized for expression in *E. coli*, driven by the | GGAAAATTTTTTAAAAAAAAACTTGACAGCT AGCTCAGTCCTTGGTATAATGCTAGCACGAAGT GAATTATATAAAAGTGGGAGGTGCCCGAATGA CGACCCGAAATGATTGCCTAGCGTTGGATGCAC AGGACAGTCTGGCTCCGCTGCGCCAACAATTTG | |

TABLE 93-continued

Constructs for Constitutive Expression of *Pseudomonas fluorescens* Kynureninase

| Description | Sequence | SEQ ID NO |
|---|---|---|
| SYN23119<br>SEQ ID NO: 890<br>Construct can be expressed from a plasmid, e.g., p15 or can be integrated into the chromosome, e.g., at the HA3/4 site | CGCTGCCGGAGGGTGTGATATACCTGGATGGCA<br>ATTCGCTGGGCGCACGTCCGGTAGCTGCGCTGG<br>CTCGCGCGCAGGCTGTGATCGCAGAAGAATGG<br>GGCAACGGGTTGATCCGTTCATGGAACTCTGCG<br>GGCTGGCGTGATCTGTCTGAACGCCTGGGTAAT<br>CGCCTGGCTACCCTGATTGGTGCGCGCGATGGG<br>GAAGTAGTTGTTACTGATACCACCTCGATTAAT<br>CTGTTTAAAGTGCTGTCAGCGGCGCTGCGCGTG<br>CAAGCTACCCGTAGCCCGGAGCGCCGTGTTATC<br>GTGACTGAGACCTCGAATTTCCCGACCGACCTG<br>TATATTGCGGAAGGGTTGGCGGATATGCTGCAA<br>CAAGGTTACACTCTGCGTTTGGTGGATTCACCG<br>GAAGAGCTGCCACAGGCTATAGATCAGGACAC<br>CGCGGTGGTGATGCTGACGCACGTAAATTATAA<br>AACCGGTTATATGCACGACATGCAGGCTCTGAC<br>CGCGTTGAGCCACGAGTGTGGGGCTCTGGCGAT<br>TTGGGATCTGGCGCACTCTGCTGGCGCTGTGCC<br>GGTGGACCTGCACCAAGCGGGCGCGGACTATG<br>CGATTGGCTGCACGTACAAATACCTGAATGGCG<br>GCCCGGGTTCGCAAGCGTTTGTTTGGGTTTCGC<br>CGCAACTGTGCGACCTGGTACCGCAGCCGCTGT<br>CTGGTTGGTTCGGCCATAGTCGCCAATTCGCGA<br>TGGAGCCGCGCTACGAACCTTCTAACGGCATTG<br>CTCGCTATCTGTGCGGCACTCAGCCTATTACTA<br>GCTTGGCTATGGTGGAGTGCGGCCTGGATGTGT<br>TTGCGCAGACGGATATGGCTTCGCTGCGCCGTA<br>AAAGTCTGGCGCTGACTGATCTGTTCATCGAGC<br>TGGTTGAACAACGCTGCGCTGCACACGAACTGA<br>CCCTGGTTACTCCACGTGAACACGCGAAACGCG<br>GCTCTCACGTGTCTTTTGAACACCCCGAGGGTT<br>ACGCTGTTATTCAAGCTCTGATTGATCGTGGCG<br>TGATCGGCGATTACCGTGAGCCACGTATTATGC<br>GTTTCGGT | |
| Lpp promoter from *E. coli*<br>SEQ ID NO: 891 | ATAAGTGCCTTCCCATCAAAAAAATATTCTCAA<br>CATAAAAAACTTTGTGTAATACTTGTAACGCTA | |
| RBS | TTATATAAAAGTGGGAGGTGCCCGA | |
| Lpp promoter from *E. coli*<br>SEQ ID NO: 892 | ATAAGTGCCTTCCCATCAAAAAAATATTCTCAA<br>CATAAAAAACTTTGTGTAATACTTGTAACGCTA<br>GTGAATTATATAAAAGTGGGAGGTGCCCGA | |
| *Pseudomonas fluorescens* kynureninase driven by Lpp promoter from *E. coli*<br>SEQ ID NO: 893<br>Construct can be expressed from a plasmid, e.g., p15 or can be integrated into the chromosome, e.g., at the HA3/4 site | ATAAGTGCCTTCCCATCAAAAAAATATTCTCAA<br>CATAAAAAACTTTGTGTAATACTTGTAACGCTA<br>GTGAATTATATAAAAGTGGGAGGTGCCCGAAT<br>GACGACCCGAAATGATTGCCTAGCGTTGGATGC<br>ACAGGACAGTCTGGCTCCGCTGCGCCAACAATT<br>TGCGCTGCCGGAGGGTGTGATATACCTGGATGG<br>CAATTCGCTGGGCGCACGTCCGGTAGCTGCGCT<br>GGCTCGCGCGCAGGCTGTGATCGCAGAAGAAT<br>GGGGCAACGGGTTGATCCGTTCATGGAACTCTG<br>CGGGCTGGCGTGATCTGTCTGAACGCCTGGGTA<br>ATCGCCTGGCTACCCTGATTGGTGCGCGCGATG<br>GGGAAGTAGTTGTTACTGATACCACCTCGATTA<br>ATCTGTTTAAAGTGCTGTCAGCGGCGCTGCGCG<br>TGCAAGCTACCCGTAGCCCGGAGCGCCGTGTTA<br>TCGTGACTGAGACCTCGAATTTCCCGACCGACC<br>TGTATATTGCGGAAGGGTTGGCGGATATGCTGC<br>AACAAGGTTACACTCTGCGTTTGGTGGATTCAC<br>CGGAAGAGCTGCCACAGGCTATAGATCAGGAC<br>ACCGCGGTGGTGATGCTGACGCACGTAAATTAT<br>AAAACCGGTTATATGCACGACATGCAGGCTCTG<br>ACCGCGTTGAGCCACGAGTGTGGGGCTCTGGCG<br>ATTTGGGATCTGGCGCACTCTGCTGGCGCTGTG<br>CCGGTGGACCTGCACCAAGCGGGCGCGGACTA<br>TGCGATTGGCTGCACGTACAAATACCTGAATGG<br>CGGCCCGGGTTCGCAAGCGTTTGTTTGGGTTTC<br>GCCGCAACTGTGCGACCTGGTACCGCAGCCGCT<br>GTCTGGTTGGTTCGGCCATAGTCGCCAATTCGC<br>GATGGAGCCGCGCTACGAACCTTCTAACGGCAT<br>TGCTCGCTATCTGTGCGGCACTCAGCCTATTACT<br>AGCTTGGCTATGGTGGAGTGCGGCCTGGATGTG | |

TABLE 93-continued

Constructs for Constitutive Expression of *Pseudomonas fluorescens* Kynureninase

| Description | Sequence | SEQ ID NO |
|---|---|---|
| | TTTGCGCAGACGGATATGGCTTCGCTGCGCCGT | |
| | AAAAGTCTGGCGCTGACTGATCTGTTCATCGAG | |
| | CTGGTTGAACAACGCTGCGCTGCACACGAACTG | |
| | ACCCTGGTTACTCCACGTGAACACGCGAAACGC | |
| | GGCTCTCACGTGTCTTTTGAACACCCCGAGGGT | |
| | TACGCTGTTATTCAAGCTCTGATTGATCGTGGC | |
| | GTGATCGGCGATTACCGTGAGCCACGTATTATG | |
| | CGTTTCGGTTTCACTCCTCTGTATACTACTTTTA | |
| | CGGAAGTTTGGGATGCAGTACAAATCCTGGGCG | |
| | AAATCCTGGATCGTAAGACTTGGGCGCAGGCTC | |
| | AGTTTCAGGTGCGCCACTCTGTTACTTAA | |

In some embodiments, the Construct for Constitutive Expression of *Pseudomonas fluorescens* Kynureninase is at least about 80%, at least about 85%, at least about 90%, at least about 95%, or at least about 99% homologous to the sequence of SEQ ID NO: 888, SEQ ID NO: 889, SEQ ID NO: 890, SEQ ID NO: 891, SEQ ID NO: 892, and/or SEQ ID NO: 893.

These strains were validated in the checkerboard assay described in Example 37 to have similar ALE parameters to their plasmid-based Ptet counterpart. Lower limit of kynurenine (KYN) and ToxTrp concentration for use in the ALE experiment were established using the checkerboard assay described above herein, and lower limit concentrations corresponded to those observed for the strains expressing tet inducible KYNase from a medium copy plasmid.

Mutants derived from parental strains SYN2027 and SYN2028 were evolved by passaging in lowering concentrations of KYN and three different ToxTrp concentrations as follows.

The ALE parental strains were cultured on plates with M9 minimal media supplemented with glucose and L-kynurenine (M9+KYN). A single colony from each parent was selected, resuspended in 20 uL of sterile phosphate-buffered saline solution. This colony was then used to inoculate two cultures of M9+KYN, grown into late-logarithmic phase and the optical density was determined at 600 nm. These cultures were then diluted to $10^3$ in 3 columns of a 96-well deep-well plate with 1 mL of M9+KYNU. Each one of the three rows had different ToxTrp concentrations (increasing 2-fold), while each column had decreasing concentrations of KYN (by 2-fold). Every 12 hours, the plate was diluted back using 30 uL from the well in which the culture had grown to an OD600 of roughly 0.1. This process was repeated for five days, and then the ToxTrp concentrations were doubled to maintain selection pressure. After two weeks' time, no growth rate increases were detected and the culture was plated onto M9+KYN. All culturing was done shaking at 350 RPM at 37° C. Individual colonies were selected and screened in M9+KYN+ToxTrp media to confirm increased growth rate phenotype.

Two replicates for each parental strain (SYN20207-R1, SYN2027-R2, SYN2028-R1, and SYN2028-R2) were selected and assayed for kynurenine production.

Figure 17:
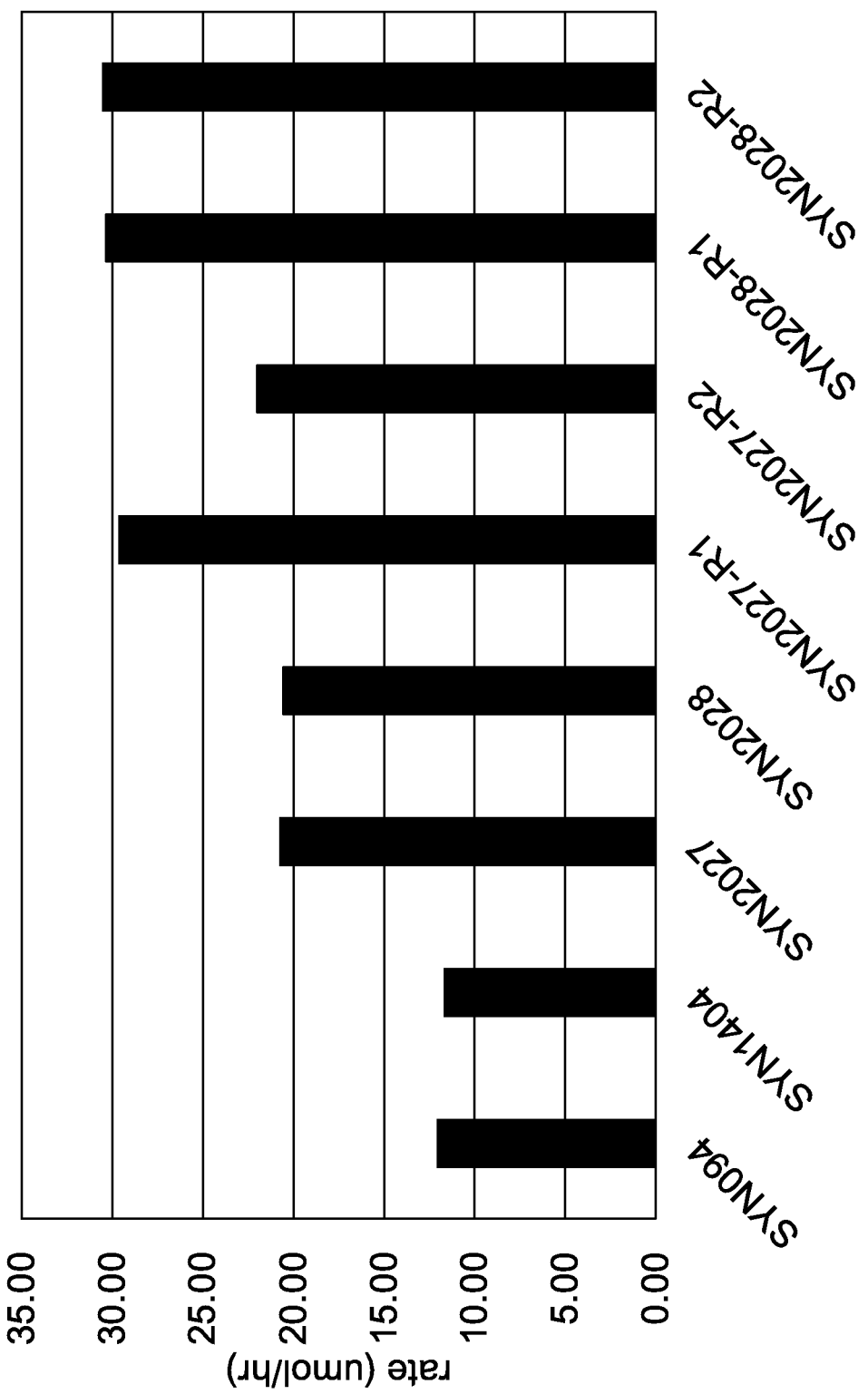
FIG. 17 depicts a bar graph showing the kynurenine consumption rates of original and ALE evolved kynureninase expressing strains in M9 media supplemented with 75 uM kynurenine. Strains are labeled as follows: SYN1404: *E. coli* Nissle comprising a deletion in Trp:E and a medium copy plasmid expressing kynureninase from *Pseudomonas fluorescens* under the control of a tetracycline inducible promoter (Nissle delta TrpE::CmR+Ptet-*Pseudomonas* KYNU p15a KanR); SYN2027: *E. coli* Nissle comprising a deletion in Trp:E and expressing kynureninase from *Pseudomonas fluorescens* under the control of a constitutive promoter (the endogenous lpp promoter) integrated into the genome at the HA3/4 site (HA3/4::Plpp-pKYNase KanR TrpE::CmR); SYN2028: *E. coli* Nissle comprising a deletion in Trp:E and expressing kynureninase from *Pseudomonas* fluorescens under the control of a constitutive promoter (the synthetic J23119 promoter) integrated into the genome at the HA3/4 site (HA3/4::PSynJ23119-pKYNase KanR TrpE::CmR); SYN2027-R1: a first evolved strain resulting from ALE, derived from the parental SYN2027 strain (Plpp-pKYNase KanR TrpE::CmR EVOLVED STRAIN Replicate 1). SYN2027-R2: a second evolved strain resulting from ALE, derived from the parental SYN2027 strain (Plpp-pKYNase KanR TrpE::CmR EVOLVED STRAIN Replicate 2). SYN2028-R1: a first evolved strain resulting from ALE, derived from the parental SYN2028 strain (HA3/4::PSynJ23119-pKYNase KanR TrpE::CmR EVOLVED STRAIN Replicate 1). SYN2028-R2: a second evolved strain resulting from ALE, derived from the parental SYN2028 strain (HA3/4::PSynJ23119-pKYNase KanR TrpE::CmR EVOLVED STRAIN Replicate 1).

Briefly, overnight cultures were diluted 1:100 in 400 ml LB and let grow for 4 hours. Next, 2 ml of the culture was spun down and resuspended in 2 ml M9 buffer. The OD600 of the culture was measured (1/100 dilution in PBS). The necessary amount of cell culture for a 3 ml assay targeting starting cell count of ~OD 0.8 (~1E8) was spun down. The cell pellet was resuspended in M9+0.5% glucose+75 uM KYN in the assay volume (3 ml) in a culture tube. 220 ul was removed in triplicate at each time point (t=0, 2, and 3 hours) into conical shaped 96WP, and 4 ul were removed for cfu measurement at each time point. At each time point, the sample was spun down in the conical 96WP for 5 minutes at 3000 g, and 200 ul were transferred from each well into a clear, flat-bottomed, 96WP. A kynurenine standard curve and blank sample was prepared in the same plate. Next, 40 ul of 30% Tri-Chloric Acid (v/v) was added to each well and mixed by pipetting up and down. The plat was sealed with aluminum foil and incubated at 60 C for 15 minutes. The plate was the spun down at 11500 rpm, at 4 C, for 15 minutes, and 125 ul from each well were aliquoted and mixed with 125 ul of 2% Ehrlich's reagent in glacial acetic acid in another 96WP. Samples were mixed pipetting up and down and the absorbance was measured at OD480. Growth rates are shown for parental strains SYN2027 and SYN2028 and the corresponding evolved strains in FIG. 17.

Example 40. Kynurenine Consuming Strains Decrease Tumoral Kynurenine Levels in the CT26 Murine Tumor Model The ability of genetically engineered bacteria comprising kynureninase from *Pseudomonas fluorescens* to consume kynurenine in vivo in the tumor environment was assessed. SYN1704, an *E. coli* Nissle strain comprising a deletion in Trp:E and a medium copy plasmid expressing kynureninase from *Pseudomonas fluorescens* under control of a constitutive promoter (Nissle delta TrpE::CmR+Pconstitutive-*Pseudomonas* KYNU KanR) was used for in a first study (Study 1).

In a second study (Study 2) the activity of SYN2028, an *E. coli* Nissle strain comprising a deletion in Trp:E and an integrated construct expressing kynureninase from *Pseudomonas fluorescens* under the control of a constitutive promoter (Nissle HA3/4::PSynJ23119-pKYNase KanR TrpE::CmR) was assessed.

In both studies, CT26 cells obtained from ATCC were cultured according to guidlelines provided. Approximately ~1e6 cells/mouse in PBS were implanted subcutaneously into the right flank of each animal (BalbC/J (female, 8 weeks)), and tumor growth was monitored for approximately 10 days. When the tumors reached about ~100-150 mm3, animals were randomized into groups for dosing.

For intratumoral injection, bacteria were grown in LB broth until reaching an absorbance at 600 nm (A600 nm) of 0.4 (corresponding to 2×108 colony-forming units (CFU)/ mL) and washed twice in PBS. The suspension was diluted in PBS or saline so that 100 microL can be injected at the appropriate doses intratumorally into tumor-bearing mice.

Study 1

Approximately 10 days after CT 26 implantation, bacteria were suspended in 0.1 ml of PBS and mice were injected (5e6 cells/mouse) with 100 ul intratumorally as follows: Group 1-Vehicle Control (n=8), Group 2-SYN94 (n=8), and Group 3-SYN1704 (n=8). From Day 2 until study end, animals were dosed intratumorally biweekly with 100 ul of vehicle control or bacteria at 5e6 cells/mouse. Animals were weighed and the tumor volume measured twice weekly. Animals were euthanized when the tumors reached ~2000 mm3 and kynurenine concentrations were measured by LC/MS as described herein. Results are shown in FIG. 18A. A significant reduction in intra tumor concentration was observed for the kynurenine consuming strain SYN1704 and for wild type *E. coli* Nissle. Intratumoral kynurenine levels were reduced in SYN1704, as compared to wild type Nissle, although the difference did not reach significance due to one outlier.

Study 2

Approximately 10 days after CT 26 implantation, bacteria were suspended in 0.1 ml of saline and mice were injected (1e8 cells/mouse) with the bacterial suspension intratumorally as follows: Group 1-Vehicle Control (n=10), Group 2-SYN94 (n=10), Group 3-SYN2028 (n=10). Group 5 (n=10) received INCB024360 (IDO inhibitor) via oral gavage as a control twice daily. From Day 2 until study end, animals were dosed intratumorally biweekly with 100 ul of vehicle control or bacteria at 1e8 cells/mouse. Animals were weighed and the tumor volume measured twice weekly. Group 5 received INCB024360 via oral gavage as a control twice daily until study end. Animals were euthanized when the tumors reached ~2000 mm3. Tumor fragments were placed in pre-weighed bead-buster tubes and store don ice for analysis. Kynurenine concentrations were measured by LC/MS as described herein. Results are shown in FIG. 18B. A significant reduction in intra tumor concentration was observed for the kynurenine consuming strain SYN2028as compared to wild type Nissle or wild type control. Intratumoral kynurenine levels seen in SYN2028 were similar to those observed for the IDO inhibitor INCB024360.

Example 41. Kynurenine Quantification in Bacterial Supernatant by LC-MS/MS

Sample Preparation

Kynurenine standards (250, 100, 20, 4, 0.8, 0.16, 0.032 m/mL) were prepared in water from Kynurenine stock in 0.5N HCl. Sample (10 µL)(and standards) were mixed with 90 µL of ACN/H$_2$O (60:30, v/v) in a V-bottom 96-well plate. The plate was heat-sealed with a AlumASeal foil and mixed well, and centrifuged at 4000 rpm for 5 min. 10 µL of the solution was transferred to a round-bottom 96-well plate, and 90 uL 0.1% formic acid in water was added to the sample. The plate was heat sealed with a ClearASeal sheet and mixed well.

LC-MS/MS Method

Kynurenine was measured by liquid chromatography coupled to tandem mass spectrometry (LC-MS/MS) using a Thermo TSQ Quantum Max triple quadrupole mass spectrometer. Table 94, Table 95, and Table 96 provide the summary of the LC-MS/MS method.

TABLE 94

| LC-MS/MS Method | |
|---|---|
| Column: | Accucore aQ column, 2.6 µm (100 × 2.1 mm) |
| Mobile Phase A: | 99.9% H2O, 0.1% Formic Acid |
| Mobile Phase B: | 99.9% ACN, 0.1% Formic Acid |
| Injection volume: | 10 uL |

TABLE 95

| HPLC Method | | | |
|---|---|---|---|
| Time (min) | Flow Rate (µL/min) | A % | B % |
| −0.5 | 350 | 100 | 0 |
| 0.5 | 350 | 100 | 0 |
| 1.0 | 350 | 10 | 90 |
| 2.5 | 350 | 10 | 90 |
| 2.51 | 350 | 100 | 10 |

TABLE 96

| Tandem Mass Spectrometry | |
|---|---|
| Ion Source: | HESI-II |
| Polarity: | Positive |
| SRM transitions: | |
| Kynurenine: | 209.1/91.2 |
| | 209.1/146.1 |

Example 42. Kynurenine Quantification in Tumor Tissue by LC-MS/MS

Sample Preparation

Kynurenine standards (100, 20, 4, 0.8, 0.16, 0.032, 0.0064 m/mL) were prepared in water from Kynurenine stock in 0.5N HCl. Weighed tumor tissues were homogenized with PBS in BeadBug prefilled tubes using a FastPrep homogenizer and the homogenate was transferred into a V-bottom 96-well plate and centrifuged at 4000 rpm for 10 min. Sample (40 µL)(and standards) were mixed with 60 µL of ACN containing 1 µg/mL of Adenosine-13C$_5$ (used as internal standard) in the final solution in a V-bottom 96-well plate. The plate was heat-sealed with a AlumASeal foil and mixed well, and centrifuged at 4000 rpm for 5 min. 10 µL of the solution was transferred to a round-bottom 96-well plate, and 90 uL 0.1% formic acid in water was added to the sample. The plate was heat sealed with a ClearASeal sheet and mixed well.

LC-MS/MS Method

Kynurenine was measured by liquid chromatography coupled to tandem mass spectrometry (LC-MS/MS) using a Thermo TSQ Quantum Max triple quadrupole mass spectrometer. Table 97, Table 98, and Table 99 provide the summary of the LC-MS/MS method.

TABLE 97

| LC-MS/MS Method | |
|---|---|
| Column: | Accucore aQ column, 2.6 µm (100 × 2.1 mm) |
| Mobile Phase A: | 99.9% H2O, 0.1% Formic Acid |

TABLE 97-continued

LC-MS/MS Method

| | |
|---|---|
| Mobile Phase B: | 99.9% ACN, 0.1% Formic Acid |
| Injection volume: | 10 uL |

TABLE 98

HPLC Method:

| Time (min) | Flow Rate (μL/min) | A % | B % |
|---|---|---|---|
| −0.5 | 350 | 100 | 0 |
| 0.5 | 350 | 100 | 0 |
| 1.0 | 350 | 10 | 90 |
| 2.5 | 350 | 10 | 90 |
| 2.51 | 350 | 100 | 10 |

TABLE 99

Tandem Mass Spectrometry

| | |
|---|---|
| Ion Source: | HESI-II |
| Polarity: | Positive |
| SRM transitions: | |
| Kynurenine: | 209.1/91.2 |
| | 209.1/146.1 |
| Adenosine-13$C_5$: | 273.1/136.2 |

Example 43. Efficacy of Genetically Engineered Bacteria in a Mouse Model of Hyperammonemia and UCD (Spf-Ash) Maintained on a High Protein Diet The hyperammonia/UCD (spf-ash) model described in Example 14 was used to assess the in vivo efficacy of genetically engineered bacteria encoding ArgAfbr driven by a fnr promoter on a low copy plasmid on ammonia levels upon administration of a high protein diet.

Two strains encoding ArgAfbr driven by a fnr promoter on a low copy plasmid, SYN-UCD206 (comprising ΔArgR and ΔThyA and argA$^{fbr}$ expressed under the control of a FNR-inducible promoter (fnrS2) on a low-copy plasmid) and SYN-UCD205 (comprising ΔArgR and argA$^{fbr}$ expressed under the control of a FNR-inducible promoter (fnrS2) on a low-copy plasmid) were compared to determine whether thymidine auxotrophy can influence the efficacy of ammonia removal from the blood.

Spf-ash mice were treated by oral administration with the genetically engineered bacteria (SYN-UCD205, SYN-UCD206) or $H_2O$ control. Normal or high protein chow was provided as follows: SYN-UCD205, high protein chow (n=10); SYN-UCD206, high protein chow (n=10); $H_2O$ control, normal chow (n=10); $H_2O$ control, high protein chow (n=10). For SYN-UCD205 and SYN-UCD206, a dose of 100 ul of >1×10$^{10}$ cells/ml was administered twice a day for 12 days, with the exception of days 1, 5, 6, and 7, where bacteria were administered once. On Day 1, mice were weighed and randomized. T=0 NH4 levels were determined from mandibular bleeds using the PocketChem Ammonia Analyzer (Arkray), and mice were subsequently and gavaged. On day 2, mice were gavaged in the morning and afternoon. On day 3, mice were gavaged in the morning and afternoon and the chow was changed from normal chow to 70% protein chow. On day 4, mice were gavaged in the morning and afternoon. On day 5, mice were gavaged in the morning and weighed, and blood was drawn 4 h post-dosing to obtain ammonia levels. On days 8 through 12, mice were gavaged in the morning and afternoon.

As seen in FIG. 24, ammonia levels of spf-ash mice in a high protein diet were reduced 48 hours after switch to high protein chow in the SYN-UCD205 and SYN-UCD206 groups as compared to the $H_2O$ high protein diet control group, indicating that the FNR inducible promoter can drive ArgAfbr expression, resulting in decreased ammonia levels in the blood of the mice treated with the engineered bacteria. The observed reduction in ammonia levels was similar in both SYN-UCD205 and SYN-UCD206, indicating that ThyA auxotrophy does not have a significant effect on efficacy of SYN-UCD206.

Example 44. Comparison of In Vitro Efficacy of Chromosomal Insertion and Plasmid-Bearing Engineered Bacterial Strains To compare the in vitro efficacy between engineered bacterial strains harboring a chromosomal insertion of ArgAfbr driven by an fnr inducible promoter at the malEK locus and strains with a low copy plasmid comprising ArgAfbr driven by an fnr inducible promoter, arginine levels in the media were measured at various time points post anaerobic induction. Additionally, to assess whether auxotrophy for thymidine may have an effect on arginine production efficiency, arginine production of engineered bacterial strains with or without a ThyA deletion, comprising the fnr-ArgAfbr on a low copy plasmid or integrated on the chromosome, were compared.

Overnight cultures were diluted 1:100 in LB and grown with shaking (250 rpm) at 37° C. After 1.5 hrs of growth, the bacteria cultures were induced as follows: (1) bacteria comprising FNR-inducible argA$^{fbr}$ were induced in LB at 37° C. for 4 hrs in anaerobic conditions in a Coy anaerobic chamber (supplying 90% $N_2$, 5% $CO_2$, 5% $H_2$, and 20 mM nitrate) at 37° C.; (2) bacteria comprising tetracycline-inducible argA$^{fbr}$ were induced with anhydrotetracycline (100 ng/mL). After induction, bacteria were removed from the incubator and spun down at maximum speed for 5 min. The cells were resuspended in 1 mL M9 glucose, and the $OD_{600}$ was measured. Cells were diluted until the $OD_{600}$ was between 0.6-0.8. Resuspended cells in M9 glucose media were grown aerobically with shaking at 37 C. 100 μL of the cell resuspension was removed and the $OD_{600}$ is measured at time=0. A 100 μL aliquot was frozen at −20° C. in a round-bottom 96-well plate for mass spectrometry analysis (LC-MS/MS). At each subsequent time point (e.g., 30, 60, and 120 min), 100 μL of the cell suspension was removed and the $OD_{600}$ was measured; a 100 μL aliquot was frozen at −20 C in a round-bottom 96-well plate for mass spectrometry analysis. Samples were analyzed for arginine concentrations. At each time point, normalized concentrations as determined by mass spectrometry vs. $OD_{600}$ were used to determine the rate of arginine production per cell per unit time. A summary of the LC-MS/MS method is provided above.

Arginine production at 30, 60, and 120 min post induction was compared between (1) Syn-UCD301 (SYN825; comprising ΔArgR and argA$^{fbr}$ expressed under the control of a FNR-inducible promoter integrated into the chromosome at the malEK locus), (2) SYN-UCD205 (comprising ΔArgR and argA$^{fbr}$ expressed under the control of a FNR-inducible promoter on a low-copy plasmid), and (3) SYN-UCD206 (comprising ΔArgR and ΔThyA and argA$^{fbr}$ expressed under the control of a FNR-inducible promoter on a low-copy plasmid. SYN-UCD103 was used as is a control Nissle construct and results are shown in FIG. 25A.

FIG. 25A shows the levels of arginine production of SYN-UCD205, SYN-UCD206, and SYN-UCD301 measured at 0, 30, 60, and 120 minutes. Arginine production was comparable between all three strains, with the greatest arginine production seen with SYN-UCD301 at 120 minutes, indicating that chromosomal integration of FNR ArgA fbr results in similar levels of arginine production as seen with the low copy plasmid strains expressing the same construct, and may even slightly increase the rate of arginine production. SYN-UCD206 exhibited attenuated arginine production as compared to SYN-UCD205 and SYN-UCD-301 (lower arginine levels at 60 minutes), but reached comparable arginine production levels at 120 minutes, indicating that ΔThyA may have a slight attenuating effect on arginine production. No arginine production was detected for the SYN-UCD103 control.

Next, samples were prepared as described above and arginine production at 120 min post induction was compared between (1) SYN-UCD204 (comprising ΔArgR and argA$^{fbr}$ expressed under the control of a tetracycline-inducible promoter on a low-copy plasmid), and (2) SYN-UCD301 (comprising ΔArgR, CmR and argA$^{fbr}$ expressed under the control of a FNR-inducible promoter integrated into the chromosome at the malEK locus), (3) SYN-UCD302 (comprising ΔArgR, ΔThyA, CmR (chloramphenicol resistance) and argAfbr expressed under the control of a FNR-inducible promoter integrated into the chromosome at the malEK locus), and (4) SYN-UCD303 (comprising ΔArgR, ΔThyA, KanR (kanamycin resistance) and argAfbr expressed under the control of a FNR-inducible promoter integrated into the chromosome at the malEK locus).

SYN-UCD106, comprising ΔArgR and ΔThyA was used as is a control Nissle construct. Results are shown in FIG. 25B. As seen in FIG. 25B, arginine production was elevated to between 0.7 and 0.9 umol/1×10$^9$ cells, indicating that arginine production is at similar levels in strains bearing ArgAfbr on a plasmid and strains with integrated copies of ArgAfbr.

Example 45. Efficacy of Genetically Engineered Bacteria in a Mouse Model of Hyperammonemia and UCD (Spf-Ash) Maintained on a High Protein Diet The hyperammonia/UCD (spf-ash) model described in Example 14 was used to assess the in vivo efficacy of genetically engineered bacteria encoding ArgAfbr driven by a fnr promoter integrated into the bacterial chromosome on ammonia levels upon administration of a high protein diet. Mice were treated with unmodified control Nissle bacteria or Nissle bacteria engineered to produce high levels of arginine or citrulline as described above.

Two strains, one with a ThyA deletion (SYN-UCD303) and one without a ThyA deletion (SYN-UCD301) were tested for efficacy and compared to determine whether ΔThyA may influence the efficacy of ammonia removal from the blood with these stains harboring chromosomal fnr-ArgAfbr.

Spf-ash mice were treated by oral administration with the genetically engineered bacteria (SYN-UCD301, SYN-UCD303) or H$_2$O control. Normal and high protein chow was provided as follows: SYN-UCD301, high protein chow (n=10); SYN-UCD303, high protein chow (n=10); H$_2$O control, normal chow (n=10); H$_2$O control, high protein chow (n=10). For SYN-UCD301, SYN-UCD303, and SYN-UCD106, a dose of 100 ul of >1×10$^{10}$ cells/ml was administered twice a day for 12 days, with the exception of days 1, 5, 6, and 7, where bacteria were administered once. Essentially the same protocol was followed as described in Example 43, with blood being drawn on day 5 to obtain ammonia levels (FIG. 25C).

As depicted in FIG. 25C, ammonia levels of spf-ash mice in a high protein diet were reduced in the SYN-UCD301 and SYN-UCD303 groups as compared to the H$_2$O high protein diet control group, indicating that the FNR inducible promoter can drive ArgAfbr expression when the construct is integrated into the chromosome, resulting in decreased ammonia levels in the blood of the mice treated with the engineered bacteria. The observed reduction in ammonia levels was similar in both SYN-UCD301 and SYN-UCD303, indicating that ThyA auxotrophy does not have a significant effect on efficacy of SYN-UCD303.

Additional strains useful for the production of arginine can be found in co-owned International Patent Application PCT/US2016/034200, filed May 25, 2016 and U.S. patent application Ser. No. 15/164,828 filed May 25, 2016, published as US20160333326, and International Patent Application PCT/US2015/064140, filed Dec. 4, 2015, and U.S. Pat. No. 9,487,764, filed Dec. 4, 2015, the contents of each of which are herein incorporated by reference in their entireties.

Example 46. Quantifying Arginine and Citrulline

For bacterial culture supernatants, samples of 500, 100, 20, 4, and 0.8 µg/mL arginine and citrulline standards in water are prepared. In a round-bottom 96-well plate, 20 µL of sample (bacterial supernatant or standards) is added to 80 µL of water with L-Arginine-$^{13}C_6,^{15}N_4$ (Sigma) and L-Citrulline-2,3,3,4,4,5,5-d7 (CDN isotope) internal standards at a final 2 µm/mL concentration. The plate is heat-sealed with a PierceASeal foil and mixed well. In a V-bottom 96-well polypropylene plate, 5 µL of diluted samples is added to 95 µL of derivatization mix (85 µL 10 mM NaHCO$_3$ pH 9.7 and 10 µL 10 mg/mL dansyl-chloride (diluted in acetonitrile). The plate is heat-sealed with a ThermASeal foil and mixed well. The samples are incubated at 60° C. for 45 min for derivatization and centrifuged at 4000 rpm for 5 min. In a round-bottom 96-well plate, 20 µL of the derivatized samples are added to 180 µL of water with 0.1% formic acid. The plate is heat-sealed with a ClearASeal sheet and mixed well.

Arginine and citrulline are measured by liquid chromatography coupled to tandem mass spectrometry (LC-MS/MS) using a Thermo TSQ Quantum Max triple quadrupole mass spectrometer. Table 100 below provides a summary of a LC-MS/MS method.

TABLE 100

| a LC-MS/MS Method Summary | | | | |
|---|---|---|---|---|
| HPLC | | | | |
| Column | Luna C18(2) column, 5 µm (50 × 2.1 mm) | | | |
| Mobile Phase A | 100% H$_2$O, 0.1% Formic Acid) | | | |
| Mobile Phase B | 100% ACN, 0.1% Formic Acid | | | |
| HPLC Method | Total Time (min) | Flow Rate (µL/min) | A % | B % |
| | 0.00 | 400 | 90.0 | 10.0 |
| | 0.50 | 400 | 90.0 | 10.0 |

TABLE 100-continued a LC-MS/MS Method Summary

| | | | | |
|---|---|---|---|---|
| 2.00 | 400 | | 10.0 | 90.0 |
| 3.25 | 400 | | 10.0 | 90.0 |
| 3.26 | 400 | | 90.0 | 10.0 |
| 4.30 | 400 | | 90.0 | 10.0 |

| | |
|---|---|
| Injection Volume | 10 μL |

Tandem Mass Spectrometry

| | |
|---|---|
| Ion Source | HESI-II |
| Polarity | Positive |
| SRM transitions | L-Arginine: 408.1/170.1 |
| | L-Arginine-$^{13}C_6,^{15}N_4$: 418.1/170.0 |
| | L-Citrulline: 409.1/170.2 |
| | L-Citrulline-2,3,3,4,4,5,5-d7: 416.1/170.1 |

Intracellular arginine and secreted (supernatant) arginine production in the genetically engineered bacteria in the presence or absence an ATC or anaerobic inducer is measured and compared to control bacteria of the same strain under the same conditions.

Total arginine production over 6 hrs in the genetically engineered bacteria in the genetically engineered bacteria in the presence or absence an ATC or anaerobic inducer is measured and compared to control bacteria of the same strain under the same conditions.

Example 47. Comparison of In Vitro Efficacy of Chromosomal Insertion and Plasmid-Bearing Engineered Bacterial Strains The in vitro efficacy (arginine production from ammonia) in an engineered bacterial strain harboring a chromosomal insertion of ArgAfbr driven by an fnr inducible promoter at the malEK locus, with ΔArgR and a ThyA deletion and no antibiotic resistance was assessed (SYN-UCD303).

Overnight cultures were diluted 1:100 in LB and grown with shaking (250 rpm) at 37° C. After 1.5 hrs of growth, the bacteria cultures were induced in LB at 37° C. for 4 hrs in anaerobic conditions in a Coy anaerobic chamber (supplying 90% $N_2$, 5% $CO_2$, 5% $H_2$, and 20 mM nitrate) at 37° C. After induction, bacteria were removed from the incubator and spun down at maximum speed for 5 min. The cells were resuspended in 1 mL M9 glucose, and the $OD_{600}$ was measured. Cells were diluted until the $OD_{600}$ was between 0.6-0.8. Resuspended cells in M9 glucose media were grown aerobically with shaking at 37 C. 100 μL of the cell resuspension was removed and the $OD_{600}$ is measured at time=0. A 100 μL aliquot was frozen at −20° C. in a round-bottom 96-well plate for mass spectrometry analysis (LC-MS/MS). At each subsequent time point (e.g., 20, 40, 60, 80, 100, and 120 min), 100 μL of the cell suspension was removed and the $OD_{600}$ was measured; a 100 μL aliquot was frozen at −20 C in a round-bottom 96-well plate for mass spectrometry analysis. Samples were analyzed for arginine concentrations. At each time point, normalized concentrations as determined by mass spectrometry vs. $OD_{600}$ were used to determine the rate of arginine production per cell per unit time. A summary of the LC-MS/MS method is provided herein. Results are shown in FIG. 26.

Example 48. Generation of Constructs and Bacteria for Cytokine Secretion

To produce strains capable of secreting immune modulatory polypeptides, e.g., cytokines, such as hIL-12, mIL-12, hIL-15, GMCSF, TNF-alpha, and IFN-gamma, several constructs were designed employing different secretion strategies. Various cytokine constructs were synthesized, and cloned into vector pBR322 for transformation of E. coli. In some embodiments, the constructs encoding the effector molecules are integrated into the genome. In some embodiments, the constructs encoding the effector molecules are on a plasmid, e.g., a medium copy plasmid.

TABLE 101

Secretion Tags and FliC components

| Sequence Name | Sequence |
|---|---|
| fliC-FliC20 FliC20: start of the fliC gene which (in some constructs) precedes the effector polypeptide sequence, see e.g., FIG. 28B and FIG. 28C shown in italics fliC: native fliC UTR in bold, optimized RBS underlined SEQ ID NO: 894 | TGACGGCGATTGAGCCGACGGGTGGAAACC CAAAACGTAATCAACGTGGGTACTCCTTAAA TTGGGTTCGAATGGACCATGGCACAAGTCATTA ATACCAACAGCCTCTCGCTGATCACTCAAAATAATA TCAACAAG |
| fliC-RBS fliC: native fliC UTR in bold, optimized RBS underlined SEQ ID NO: 895 | TGACGGCGATTGAGCCGACGGGTGGAAACC CAAAACGTAATCAACTACGAACACTTACAGG AGGTACCCA |
| fliC-RBS fliC: native fliC UTR in bold, optimized RBS underlined SEQ ID NO: 896 | TGACGGCGATTGAGCCGACGGGTGGAAACC CAAAACGTAATCAACAAGTATAAACTCTGGG AGGTTCCTA |

TABLE 101-continued

Secretion Tags and FliC components

| Sequence Name | Sequence |
|---|---|
| fliC-RBS<br>fliC: native fliC UTR in bold, optimized RBS underlined<br>SEQ ID NO: 897 | TGACGGCGATTGAGCCGACGGGTGGAAACC<br>CAAAACGTAATCAACTCAAATCCCTTAATAA<br>GGAGGTAAA |
| RBS-phoA<br>RBS: underlined<br>SEQ ID NO: 898 | CTCTAGAAATAATTTTGTTTAACTTTAAGAAGG<br>AGATATACATATGAAACAAAGCACTATTGCACT<br>GGCACTCTTACCGTTACTGTTTACCCCTGTGACA<br>AAAGCG |
| phoA<br>SEQ ID NO: 899 | ATGAAACAAAGCACTATTGCACTGGCACTCTTA<br>CCGTTACTGTTTACCCCTGTGACAAAAGCG |
| RBS-ompF<br>RBS: underlined<br>SEQ ID NO: 900 | CTCTAGAAATAATTTTGTTTAACTTTAAGAAGG<br>AGATATACATATGATGAAGCGCAATATTCTGGC<br>AGTGATCGTCCCTGCTCTGTTAGTAGCAGGTAC<br>TGCAAACGCT |
| ompF<br>SEQ ID NO: 901 | ATGATGAAGCGCAATATTCTGGCAGTGATCGTC<br>CCTGCTCTGTTAGTAGCAGGTACTGCAAACGCT |
| RBS-cvaC<br>RBS: underlined<br>SEQ ID NO: 902 | CTCTAGAAATAATTTTGTTTAACTTTAAGAAGG<br>AGATATACATATGAGAACTCTGACTCTAAATGA<br>ATTAGATTCTGTTTCTGGTGGT |
| cvaC<br>SEQ ID NO: 903 | ATGAGAACTCTGACTCTAAATGAATTAGATTCT<br>GTTTCTGGTGGT |
| RBS-phoA (Optimized)<br>RBS: underlined<br>SEQ ID NO: 904 | GACGCCAGAGAGTTAAGGGGGTTAAATGAAAC<br>AATCGACCATCGCATTGGCGCTGCTTCCTCTATT<br>GTTCACACCGGTGACAAAGGCA |
| Optimized phoA<br>SEQ ID NO: 905 | ATGAAACAATCGACCATCGCATTGGCGCTGCTT<br>CCTCTATTGTTCACACCGGTGACAAAGGCA |
| RBS-TorA<br>RBS: underlined<br>SEQ ID NO: 906 | CTCTAGAAATAATTTTGTTTAACTTTAAGAAGG<br>AGATATACATATGAACAATAACGATCTCTTTCA<br>GGCATCACGTCGGCGTTTTCTGGCACAACTCGG<br>CGGCTTAACCGTCGCCGGGATGCTGGGGCCGTC<br>ATTGTTAACGCCGCGACGTGCGACTGCG |
| TorA<br>SEQ ID NO: 907 | ATGAACAATAACGATCTCTTTCAGGCATCACGT<br>CGGCGTTTTCTGGCACAACTCGGCGGCTTAACC<br>GTCGCCGGGATGCTGGGGCCGTCATTGTTAACG<br>CCGCGACGTGCGACTGCG |
| RBS-TorA alternate<br>RBS: underlined<br>SEQ ID NO: 908 | CCCACATTCGAGGTACTAAATGAACAATAACGA<br>TCTCTTTCAGGCATCACGTCGGCGTTTTCTGGCA<br>CAACTCGGCGGCTTAACCGTCGCCGGGATGCTG<br>GGGACGTCATTGTTAACGCCGCGCCGTGCGACT<br>GCGGCGCAAGCGGCG |
| TorA (alternate)<br>SEQ ID NO: 909 | ATGAACAATAACGATCTCTTTCAGGCATCACGT<br>CGGCGTTTTCTGGCACAACTCGGCGGCTTAACC<br>GTCGCCGGGATGCTGGGGACGTCATTGTTAACG<br>CCGCGCCGTGCGACTGCGGCGCAAGCGGCG |
| RBS-fdnG<br>RBS: underlined<br>SEQ ID NO: 910 | ACCCTATTACACACCTAAGGAGGCCAAATACAT<br>GGACGTCAGTCGCAGACAATTTTTTAAAATCTG<br>CGCGGGCGGTATGGCGGGAACAACAGTAGCAG<br>CATTGGGCTTTGCCCCGAAGCAAGCACTGGCT |
| fdnG<br>SEQ ID NO: 911 | ATGGACGTCAGTCGCAGACAATTTTTTAAAATC<br>TGCGCGGGCGGTATGGCGGGAACAACAGTAGC<br>AGCATTGGGCTTTGCCCCGAAGCAAGCACTGGCT |
| RBS-dmsA<br>RBS: underlined<br>SEQ ID NO: 912 | TACGCAAAAAACATAATTTAAGAGAGGATAAA<br>CATGAAAACGAAAATCCCTGATGCGGTATTGGC<br>TGCTGAGGTGAGTCGCCGTGGTTTGGTAAAAAC<br>GACAGCGATCGGCGGCCTGGCAATGGCCAGCA<br>GCGCATTAACATTACCTTTTAGTCGGATTGCGC<br>ACGCT |

TABLE 101-continued

Secretion Tags and FliC components

| Sequence Name | Sequence |
| --- | --- |
| dmsA<br>SEQ ID NO: 913 | ATGAAAACGAAAATCCCTGATGCGGTATTGGCT<br>GCTGAGGTGAGTCGCCGTGGTTTGGTAAAAACG<br>ACAGCGATCGGCGGCCTGGCAATGGCCAGCAG<br>CGCATTAACATTACCTTTTAGTCGGATTGCGCA<br>CGCT |

In some embodiments, genetically engineered bacteria comprise a nucleic acid sequence that is at least about 80%, at least about 85%, at least about 90%, at least about 95%, or at least about 99% homologous to the DNA sequence of SEQ ID NO: 894, SEQ ID NO: 895, SEQ ID NO: 896, SEQ ID NO: 897, SEQ ID NO: 898, SEQ ID NO: 899, SEQ ID NO: 900, SEQ ID NO: 901, SEQ ID NO: 902, SEQ ID NO: 903, SEQ ID NO: 904, SEQ ID NO: 905, SEQ ID NO: 906, SEQ ID NO: 907, SEQ ID NO: 908, SEQ ID NO: 909, SEQ ID NO: 910, SEQ ID NO: 911, SEQ ID NO: 912, and/or SEQ ID NO: 913.

Table 102 lists exemplary promoter sequences and miscellaneous construct sequences.

TABLE 102

Promoter Sequences and Various Construct Sequences

| Description | Sequence |
| --- | --- |
| TetR/TetA<br>Promoter<br>SEQ ID NO: 914 | GAATTCGTTAAGACCCACTTTCACATTTAAGTTGTTTTTCTAA<br>TCCGCATATGATCAATTCAAGGCCGAATAAGAAGGCTGGCT<br>CTGCACCTTGGTGATCAAATAATTCGATAGCTTGTCGTAATA<br>ATGGCGGCATACTATCAGTAGTAGGTGTTTCCCTTTCTTCTTT<br>AGCGACTTGATGCTCTTGATCTTCCAATACGCAACCTAAAGT<br>AAAATGCCCCACAGCGCTGAGTGCATATAATGCATTCTCTAG<br>TGAAAAACCTTGTTGGCATAAAAAAGGCTAATTGATTTTCGAG<br>AGTTTCATACTGTTTTTCTGTAGGCCGTGTACCTAAATGTACT<br>TTTGCTCCATCGCGATGACTTAGTAAAGCACATCTAAAACTTT<br>TTAGCGTTATTACGTAAAAAATCTTGCCAGCTTTCCCCTTCTA<br>AAGGGCAAAAGTGAGTATGGTGCCTATCTAACATCTCAATG<br>GCTAAGGCGTCGAGCAAAGCCCGCTTATTTTTTACATGCCAA<br>TACAATGTAGGCTGCTCTACACCTAGCTTCTGGGCGAGTTTA<br>CGGGTTGTTAAACCTTCGATTCCGACCTCATTAAGCAGCTCT<br>AATGCGCTGTTAATCACTTTACTTTTATCTAATCTAGACATCA<br>TTAATTCCTAATTTTTGTTGACACTCTATCATTGATAGAGTTA<br>TTTTACCACTCCCTATCAGTGATAGAGAAAAGTGAA |
| fliC Promoter<br>SEQ ID NO:<br>915 | AGCGGGAATAAGGGGCAGAGAAAAGAGTATTTCGTCGACTA<br>ACAAAAAATGGCTGTTTGTGAAAAAAATTCTAAAGGTTGTTT<br>TACGACAGACGATAACAGGGT |
| FnrS<br>Promoter<br>SEQ ID NO:<br>916 | GGTACCAGTTGTTCTTATTGGTGGTGTTGCTTTATGGTTGCAT<br>CGTAGTAAATGGTTGTAACAAAAGCAATTTTTCCGGCTGTCT<br>GTATACAAAAACGCCGCAAAGTTTGAGCGAAGTCAATAAAC<br>TCTCTACCCATTCAGGGCAATATCTCTCTTGGATCC |
| DOM<br>Construct<br>Terminator<br>SEQ ID NO:<br>917 | CACATTTCCCCGAAAAGTGCCGATGGCCCCCCGATGGTAGTG<br>TGGCCCATGCGAGAGTAGGGAACTGCCAGGCATCAAATAAA<br>ACGAAAGGCTCAGTCGAAAGACTGGGCCTTTCGTTTTATCTG<br>TTGTTTGTCGGTGAACGCTCTCCTGAGTAGGACAAATCCGCC<br>GGGAGCGGATTTGAACGTTGCGAAGCAACGGCCCGGAGGGT<br>GGCGGGCAGGACGCCCGCCATAAACTGCCAGGCATCAAATT<br>AAGCAGAAGGCCATCCTGACGGATGGCCTTTTTGCGTGGCCA<br>GTGCCAAGCTTGCATGCAGATTGCAGCATTACACGTCTTGAG<br>CGATTGTGTAGGCTGGAGCTGCTTC |
| FRT Site<br>SEQ ID NO:<br>918 | GAAGTTCCTATACTTTCTAGAGAATAGGAACTTCGGAATAGG<br>AACTTC |
| Kanamycin<br>Resistance<br>Cassette (for<br>integration in<br>between FRT<br>sites)<br>SEQ ID NO:<br>919 | AAGATCCCCTCACGCTGCCGCAAGCACTCAGGGCGCAAGGG<br>CTGCTAAAGGAAGCGGAACACGTAGAAAGCCAGTCCGCAGA<br>AACGGTGCTGACCCCGGATGAATGTCAGCTACTGGGCTATCT<br>GGACAAGGGAAAACGCAAGCGCAAAGAGAAAGCAGGTAGC<br>TTGCAGTGGGCTTACATGGCGATAGCTAGACTGGGCGGTTTT<br>ATGGACAGCAAGCGAACCGGAATTGCCAGCTGGGGCGCCCT<br>CTGGTAAGGTTGGGAAGCCCTGCAAAGTAAACTGGATGGCT<br>TTCTTGCCGCCAAGGATCTGATGGCGCAGGGGATCAAGATCT<br>GATCAAGAGACAGGATGAGGATCGTTTCGCATGATTGAACA<br>AGATGGATTGCACGCAGGTTCTCCGGCCGCTTGGGTGGAGA<br>GGCTATTCGGCTATGACTGGGCACAACAGACAATCGGCTGCT |

TABLE 102-continued

Promoter Sequences and Various Construct Sequences

| Description | Sequence |
|---|---|
| | CTGATGCCGCCGTGTTCCGGCTGTCAGCGCAGGGGCGCCCGG<br>TTCTTTTTGTCAAGACCGACCTGTCCGGTGCCCTGAATGAAC<br>TGCAGGACGAGGCAGCGCGGCTATCGTGGCTGGCCACGACG<br>GGCGTTCCTTGCGCAGCTGTGCTCGACGTTGTCACTGAAGCG<br>GGAAGGGACTGGCTGCTATTGGGCGAAGTGCCGGGGCAGGA<br>TCTCCTGTCATCTCACCTTGCTCCTGCCGAGAAAGTATCCATC<br>ATGGCTGATGCAATGCGGCGGCTGCATACGCTTGATCCGGCT<br>ACCTGCCCATTCGACCACCAAGCGAAACATCGCATCGAGCG<br>AGCACGTACTCGGATGGAAGCCGGTCTTGTCGATCAGGATG<br>ATCTGGACGAAGAGCATCAGGGGCTCGCGCCAGCCGAACTG<br>TTCGCCAGGCTCAAGGCGCGCATGCCCGACGGCGAGGATCT<br>CGTCGTGACCCATGGCGATGCCTGCTTGCCGAATATCATGGT<br>GGAAAATGGCCGCTTTTCTGGATTCATCGACTGTGGCCGGCT<br>GGGTGTGGCGGACCGCTATCAGGACATAGCGTTGGCTACCC<br>GTGATATTGCTGAAGAGCTTGGCGGCGAATGGGCTGACCGC<br>TTCCTCGTGCTTTACGGTATCGCCGCTCCCGATTCGCAGCGC<br>ATCGCCTTCTATCGCCTTCTTGACGAGTTCTTCTGAGCGGGA<br>CTCTGGGGTTCGAAATGACCGACCAAGCGACGCCCAACCTG<br>CCATCACGAGATTTCGATTCCACCGCCGCCTTCTATGAAAGG<br>TTGGGCTTCGGAATCGTTTTCCGGGACGCCGGCTGGATGATC<br>CTCCAGCGCGGGGATCTCATGCTGGAGTTCTTCGCCCACCCC<br>AGCTTCAAAAGCGCTCT |

In some embodiments, genetically engineered bacteria comprise a nucleic acid sequence that is at least about 80%, at least about 85%, at least about 90%, at least about 95%, or at least about 99% homologous to the DNA sequence of SEQ ID NO: 914, SEQ ID NO: 915, SEQ ID NO: 916, SEQ ID NO: 917, SEQ ID NO: 918, and SEQ ID NO: 919.

Table 103 Lists exemplary secretion constructs.

TABLE 103

Non-limiting Examples of Secretion Constructs

| Description | Sequence |
|---|---|
| human IL-12a construct with a N terminal OmpF secretion tag (sec-dependent secretion system) (tag in bold)<br>SEQ ID NO: 920 | MMKRNILAVIVPALLVAGTANARNLPVAT<br>PDPGMFPCLHHSQNLLRAVSNMLQKARQT<br>LEFYPCTSEEIDHEDITKDKTSTVEACLPLE<br>LTKNESCLNSRETSFITNGSCLASRKTSFM<br>MALCLSSIYEDLKMYQVEFKTMNAKLLM<br>DPKRQIFLDQNMLAVIDELMQALNFNSETV<br>PQKSSLEEPDFYKTKIKLCILLHAFRIRAVTI<br>DRVMSYLNAS* |
| human IL-12a construct with a N terminal PhoA secretion tag (tag in bold)<br>SEQ ID NO: 921 | MKQSTIALALLPLLFTPVTKARNLPVATPD<br>PGMFPCLHHSQNLLRAVSNMLQKARQTLE<br>FYPCTSEEIDHEDITKDKTSTVEACLPLELT<br>KNESCLNSRETSFITNGSCLASRKTSFMMA<br>LCLSSIYEDLKMYQVEFKTMNAKLLMDPK<br>RQIFLDQNMLAVIDELMQALNFNSETVPQK<br>SSLEEPDFYKTKIKLCILLHAFRIRAVTIDRV<br>MSYLNAS* |
| human IL-12a construct with a N terminal TorA secretion tag (sec-dependent secretion system) (tag in bold)<br>SEQ ID NO: 922 | MNNNDLFQASRRRFLAQLGGLTVAGMLG<br>PSLLTPRRATARNLPVATPDPGMFPCLHHS<br>QNLLRAVSNMLQKARQTLEFYPCTSEEIDH<br>EDITKDKTSTVEACLPLELTKNESCLNSRET<br>SFITNGSCLASRKTSFMMALCLSSIYEDLK<br>MYQVEFKTMNAKLLMDPKRQIFLDQNML<br>AVIDELMQALNFNSETVPQKSSLEEPDFYK<br>TKIKLCILLHAFRIRAVTIDRVMSYLNAS* |
| human IL-12b construct with a N terminal OmpF secretion tag (sec-dependent secretion system) (tag in bold)<br>SEQ ID NO: 923 | MMKRNILAVIVPALLVAGTANAIWELKKD<br>VYVVELDWYPDAPGEMVVLTCDTPEEDGI<br>TWTLDQSSEVLGSGKTLTIQVKEFGDAGQ<br>YTCHKGGEVLSHSLLLLHKKEDGIWSTDIL<br>KDQKEPKNKTFLRCEAKNYSGRFTCWWLT<br>TISTDLTFSVKSSRGSSDPQGVTCGAATLSA<br>ERVRGDNKEYEYSVECQEDSACPAAEESLP<br>IEVMVDAVHKLKYENYTSSFFIRDIIKPDPP<br>KNLQLKPLKNSRQVEVSWEYPDTWSTPHS<br>YFSLTFCVQVQGKSKREKKDRVFTDKTSA<br>TVICRKNASISVRAQDRYYSSSWSEWASVP<br>CS* |

TABLE 103-continued

Non-limiting Examples of Secretion Constructs

| Description | Sequence |
|---|---|
| human IL-12b construct with a N terminal PhoA secretion tag (tag in bold) SEQ ID NO: 924 | MKQSTIALALLPLLFTPVTKAIWELKKDVY VVELDWYPDAPGEMVVLTCDTPEEDGITW TLDQSSEVLGSGKTLTIQVKEFGDAGQYTC HKGGEVLSHSLLLLHKKEDGIWSTDILKDQ KEPKNKTFLRCEAKNYSGRFTCWWLTTIST DLTFSVKSSRGSSDPQGVTCGAATLSAERV RGDNKEYEYSVECQEDSACPAAEESLPIEV MVDAVHKLKYENYTSSFFIRDIIKPDPPKNL QLKPLKNSRQVEVSWEYPDTWSTPHSYFS LTFCVQVQGKSKREKKDRVFTDKTSATVIC RKNASISVRAQDRYYSSSWSEWASVPCS\* |
| human IL-12 construct with a N terminal TorA secretion tag (sec-dependent secretion system) (tag in bold) SEQ ID NO: 925 | MNNNDLFQASRRRFLAQLGGLTVAGMLG PSLLTPRRATAIWELKKDVYVVELDWYPD APGEMVVLTCDTPEEDGITWTLDQSSEVLG SGKTLTIQVKEFGDAGQYTCHKGGEVLSH SLLLLHKKEDGIWSTDILKDQKEPKNKTFL RCEAKNYSGRFTCWWLTTISTDLTFSVKSS RGSSDPQGVTCGAATLSAERVRGDNKEYE YSVECQEDSACPAAEESLPIEVMVDAVHKL KYENYTSSFFIRDIIKPDPPKNLQLKPLKNS RQVEVSWEYPDTWSTPHSYFSLTFCVQVQ GKSKREKKDRVFTDKTSATVICRKNASISV RAQDRYYSSSWSEWASVPCS\* |
| murine IL-12a construct with a N terminal OmpF secretion tag (sec-dependent secretion system) (tag in bold) SEQ ID NO: 926 | MMKRNILAVIVPALLVAGTANARNLPVAT PDPGMFPCLHHSQNLLRAVSNMLQKARQT LEFYPCTSEEIDHEDITKDKTSTVEACLPLE LTKNESCLNSRETSFITNGSCLASRKTSFM MALCLSSIYEDLKMYQVEFKTMNAKLLM DPKRQIFLDQNMLAVIDELMQALNFNSETV PQKSSLEEPDFYKTKIKLCILLHAFRIRAVTI DRVMSYLNAS\* |
| murine IL-12a construct with a N terminal PhoA secretion tag (tag in bold) SEQ ID NO: 927 | MKQSTIALALLPLLFTPVTKARNLPVATPD PGMFPCLHHSQNLLRAVSNMLQKARQTLE FYPCTSEEIDHEDITKDKTSTVEACLPLELT KNESCLNSRETSFITNGSCLASRKTSFMMA LCLSSIYEDLKMYQVEFKTMNAKLLMDPK RQIFLDQNMLAVIDELMQALNFNSETVPQK SSLEEPDFYKTKIKLCILLHAFRIRAVTIDRV MSYLNAS\* |
| murine IL-12a construct with a N terminal TorA secretion tag (sec-dependent secretion system) (tag in bold) SEQ ID NO: 928 | MNNNDLFQASRRRFLAQLGGLTVAGMLG PSLLTPRRATARNLPVATPDPGMFPCLHHS QNLLRAVSNMLQKARQTLEFYPCTSEEIDH EDITKDKTSTVEACLPLELTKNESCLNSRET SFITNGSCLASRKTSFMMALCLSSIYEDLK MYQVEFKTMNAKLLMDPKRQIFLDQNML AVIDELMQALNFNSETVPQKSSLEEPDFYK TKIKLCILLHAFRIRAVTIDRVMSYLNAS\* |
| murine IL-12b construct with a N terminal OmpF secretion tag (sec-dependent secretion system) (tag in bold) SEQ ID NO: 929 | MMKRNILAVIVPALLVAGTANAMWELEK DVYVVEVDWTPDAPGETVNLTCDTPEEDD ITWTSDQRHGVIGSGKTLTITVKEFLDAGQ YTCHKGGETLSHSHLLLHKKENGIWSTEIL KNFKNKTFLKCEAPNYSGRFTCSWLVQRN MDLKFNIKSSSSSPDSRAVTCGMASLSAEK VTLDQRDYEKYSVSCQEDVTCPTAEETLPI ELALEARQQNKYENYSTSFFIRDIIKPDPPK NLQMKPLKNSQVEVSWEYPDSWSTPHSYF SLKFFVRIQRKKEKMKETEEGCNQKGAFL VEKTSTEVQCKGGNVCVQAQDRYYNSSCS KWACVPCRVRS\* |

TABLE 103-continued

Non-limiting Examples of Secretion Constructs

| Description | Sequence |
|---|---|
| murine IL-12b construct with a N terminal PhoA secretion tag (tag in bold) SEQ ID NO: 930 | MKQSTIALALLPLLFTPVTKAMWELEKDV YVVEVDWTPDAPGETVNLTCDTPEEDDIT WTSDQRHGVIGSGKTLTITVKEFLDAGQYT CHKGGETLSHSHLLLHKKENGIWSTEILKN FKNKTFLKCEAPNYSGRFTCSWLVQRNMD LKFNIKSSSSSPDSRAVTCGMASLSAEKVTL DQRDYEKYSVSCQEDVTCPTAEETLPIELA LEARQQNKYENYSTSFFIRDIIKPDPPKNLQ MKPLKNSQVEVSWEYPDSWSTPHSYFSLK FFVRIQRKKEKMKETEEGCNQKGAFLVEK TSTEVQCKGGNVCVQAQDRYYNSSCSKW ACVPCRVRS* |
| murine IL-12b construct with a N terminal TorA secretion tag (sec-dependent secretion system) (tag in bold) SEQ ID NO: 931 | MNNNDLFQASRRRFLAQLGGLTVAGMLG PSLLTPRRATAMWELEKDVYVVEVDWTP DAPGETVNLTCDTPEEDDITWTSDQRHGVI GSGKTLTITVKEFLDAGQYTCHKGGETLSH SHLLLHKKENGIWSTEILKNFKNKTFLKCE APNYSGRFTCSWLVQRNMDLKFNIKSSSSS PDSRAVTCGMASLSAEKVTLDQRDYEKYS VSCQEDVTCPTAEETLPIELALEARQQNKY ENYSTSFFIRDIIKPDPPKNLQMKPLKNSQV EVSWEYPDSWSTPHSYFSLKFFVRIQRKKE KMKETEEGCNQKGAFLVEKTSTEVQCKGG NVCVQAQDRYYNSSCSKWACVPCRVRS* |
| human GMCSF construct with a N terminal OmpF secretion tag (sec-dependent secretion system) (tag in bold) SEQ ID NO: 932 | MMKRNILAVIVPALLVAGTANAAPARSPSP STQPWEHVNAIQEARRLLNLSRDTAAEMN ETVEVISEMFDLQEPTCLQTRLELYKQGLR GSLTKLKGPLTMMASHYKQHCPPTPETSC ATQIITFESFKENLKDFLLVIPFDCWEPVQE* |
| human GMCSF construct with a N terminal PhoA secretion tag (tag in bold) SEQ ID NO: 933 | MKQSTIALALLPLLFTPVTKAAPARSPSPST QPWEHVNAIQEARRLLNLSRDTAAEMNET VEVISEMFDLQEPTCLQTRLELYKQGLRGS LTKLKGPLTMMASHYKQHCPPTPETSCAT QIITFESFKENLKDFLLVIPFDCWEPVQE* |
| human GMCSF construct with a N terminal TorA secretion tag (sec-dependent secretion system) (tag in bold) SEQ ID NO: 934 | MNNNDLFQASRRRFLAQLGGLTVAGMLG PSLLTPRRATAAPARSPSPSTQPWEHVNAIQ EARRLLNLSRDTAAEMNETVEVISEMFDLQ EPTCLQTRLELYKQGLRGSLTKLKGPLTM MASHYKQHCPPTPETSCATQIITFESFKENL KDFLLVIPFDCWEPVQE* |
| human Il-15 construct with a N terminal OmpF secretion tag (sec-dependent secretion system) (tag in bold) SEQ ID NO: 935 | MMKRNILAVIVPALLVAGTANANWVNVIS DLKKIEDLIQSMHIDATLYTESDVHPSCKV TAMKCFLLELQVISLESGDASIHDTVENLII LANNSLSSNGNVTESGCKECEELEEKNIKE FLQSFVHIVQMFINTS* |
| human Il-15 construct with a N terminal PhoA secretion tag (tag in bold) SEQ ID NO: 936 | MKQSTIALALLPLLFTPVTKANWVNVISDL KKIEDLIQSMHIDATLYTESDVHPSCKVTA MKCFLLELQVISLESGDASIHDTVENLIILA NNSLSSNGNVTESGCKECEELEEKNIKEFL QSFVHIVQMFINTS* |
| human Il-15 construct with a N terminal TorA secretion tag (sec-dependent secretion system) (tag in bold) SEQ ID NO: 937 | MNNNDLFQASRRRFLAQLGGLTVAGMLG PSLLTPRRATANWVNVISDLKKIEDLIQSM HIDATLYTESDVHPSCKVTAMKCFLLELQV ISLESGDASIHDTVENLIILANNSLSSNGNVT ESGCKECEELEEKNIKEFLQSFVHIVQMFIN TS* |
| human TNFa construct with a N terminal OmpF secretion tag (sec-dependent secretion system) (tag in bold) SEQ ID NO: 938 | MMKRNILAVIVPALLVAGTANAGPQREEF PRDLSLISPLAQAVRSSSRTPSDKPVAHVVA NPQAEGQLQWLNRRANALLANGVELRDN QLVVPSEGLYLIYSQVLFKGQGCPSTHVLL THTISRIAVSYQTKVNLLSAIKSPCQRETPE GAEAKPWYEPIYLGGVFQLEKGDRLSAEIN RPDYLDFAESGQVYFGIIAL* |

TABLE 103-continued

Non-limiting Examples of Secretion Constructs

| Description | Sequence |
|---|---|
| human TNFa construct with a N terminal PhoA secretion tag (tag in bold) SEQ ID NO: 939 | MKQSTIALALLPLLFTPVTKAGPQREEFPR DLSLISPLAQAVRSSSRTPSDKPVAHVVAN PQAEGQLQWLNRRANALLANGVELRDNQ LVVPSEGLYLIYSQVLFKGQGCPSTHVLLT HTISRIAVSYQTKVNLLSAIKSPCQRETPEG AEAKPWYEPIYLGGVFQLEKGDRLSAEINR PDYLDFAESGQVYFGIIAL* |
| human TNFa construct with a N terminal TorA secretion tag (sec-dependent secretion system) (tag in bold) SEQ ID NO: 940 | MNNNDLFQASRRRFLAQLGGLTVAGMLG PSLLTPRRATAGPQREEFPRDLSLISPLAQA VRSSSRTPSDKPVAHVVANPQAEGQLQWL NRRANALLANGVELRDNQLVVPSEGLYLI YSQVLFKGQGCPSTHVLLTHTISRIAVSYQT KVNLLSAIKSPCQRETPEGAEAKPWYEPIY LGGVFQLEKGDRLSAEINRPDYLDFAESGQ VYFGIIAL* |
| human IFNg construct with a N terminal OmpF secretion tag (sec-dependent secretion system) (tag in bold) SEQ ID NO: 941 | MMKRNILAVIVPALLVAGTANAQDPYVKE AENLKKYFNAGHSDVADNGTLFLGILKNW KEESDRKIMQSQIVSFYFKLFKNFKDDQSIQ KSVETIKEDMNVKFFNSNKKKRDDFEKLT NYSVTDLNVQRKAIHELIQVMAELSPAAKT GKRKRSQMLFRG* |
| human IFNg construct with a N terminal PhoA secretion tag (tag in bold) SEQ ID NO: 942 | MKQSTIALALLPLLFTPVTKAQDPYVKEAE NLKKYFNAGHSDVADNGTLFLGILKNWKE ESDRKIMQSQIVSFYFKLFKNFKDDQSIQKS VETIKEDMNVKFFNSNKKKRDDFEKLTNY SVTDLNVQRKAIHELIQVMAELSPAAKTGK RKRSQMLFRG* |
| human IFNg construct with a N terminal TorA secretion tag (sec-dependent secretion system) (tag in bold) SEQ ID NO: 943 | MNNNDLFQASRRRFLAQLGGLTVAGMLG PSLLTPRRATAQDPYVKEAENLKKYFNAG HSDVADNGTLFLGILKNWKEESDRKIMQS QIVSFYFKLFKNFKDDQSIQKSVETIKEDM NVKFFNSNKKKRDDFEKLTNYSVTDLNVQ RKAIHELIQVMAELSPAAKTGKRKRSQMLF RG* |
| human IL-12a construct with a N terminal PhoA secretion tag (tag in bold) SEQ ID NO: 953 | atgaaacagagcacaattgctctggccttgttgccattactgttt acccctgttactaaggctaggaacctgcctgtggcaacaccagac cctgggatgttcccttgcttacatcattcccagaacctgttgcgtgcg gtgtctaacatgctgcagaaagccaggcagacgctggaattctacc catgcacttccgaagagatagatcatgaagacattacgaaagacaa aacctcaacggttgaagcatgcttacctctggaattgactaagaatg aatcgtgcttaaactcaagagagaccagtttcatcactaatggctctt gcttagcgtcgcgcaagaccagcttcatgatggcgctctgcctaagt agcatctacgaggacctcaaaatgtaccaagttgaatttaaaactatg aatgccaaacttctaatggacccaaaaagacagatattttagatcag aatatgcttgcggttattgacgaactcatgcaggcattgaattttaattc cgagacggtgccacaaaaaagttctttggaggagccggactttac aagacaaaaatcaagctgtgcatacttcttcacgcattcagaatacg ggccgttacgatcgatcgcgtcatgtcgtatcttaatgcgagctga |
| human IL-12b construct with a N terminal PhoA secretion tag (tag in bold) SEQ ID NO: 954 | atgaagcagagcacgatcgcattggcgttgctaccgctgttgttt accccggtcacaaaagccatctgggaactgaaaaaagatgtttat gtagttgaactggattggtacccggatgcacccggtgagatggtgg ttttgacctgcgacacgccggaagaagatggcataacgtggaccct ggatcaaagctctgaagttctgggttcaggtaagacattgacgatcc aagtaaaagaatttggcgacgcaggtcagtacacctgccacaaag gtgccgaagttctgtcgcactcactcctgctcctgcacaaaaaaga ggatggcatctggagtactgatatcctaaaggatcaaaaagaacct aaaaacaaaacgttcttgcgctgtgaagcgaagaactatagtggtc gctttacgtgctggtggttgactaccatttccaccgatttgacctttct gttaagagttcgcgcggctcgtcagatccgcagggcgttacttgcg gtgcggcgacgctgtcagctgagagagttcgtgggacaacaaa gagtacgaatatagtgtagaatgtcaagaggattcggcgtgcccgg cagcagaggagtctctcccccattgaagttatggtggacgcagtgca taaactgaaatatgagaattacacatcaagctttttttattcgcgatatca tcaaaccggatcctccaaaaaatctgcaactaaagcccctgaaaaa ttcgcgccaagttgaggtgagctgggaatatccggatacttggtcga caccgcattcttatttctcactgaccttctgcgttcaggttcaaggtaa atcaaaacgagaaaaaaaggatcgcgtctttaccgacaaaacgtct gctactgtaatctgccgcaagaatgcgtcaattctgtacgtgcgcaa gatcgctactactctagtagttggtctgaatgggcttcagtgccatgc tcctgatga |

TABLE 103-continued

Non-limiting Examples of Secretion Constructs

| Description | Sequence |
|---|---|
| murine IL-12a construct with a N terminal PhoA secretion tag (tag in bold) SEQ ID NO: 955 | atgaaacagagtacgatagccctagccctgttgccgctcctgtt caccccgttactaaagcacgtaaccttccggtggccacgccag atccgggcatgttcccgtgcttacaccattcccagaatctgctgcgc gctgtgagtaatatgctgcagaaggcgagacaaactttggaatttta cccgtgcacttcggaggagattgaccatgaggatatcacaaaagac aaaaccagtacagtggaagcctgctgcccttgaactgactaaaa atgagagttgtttaaattcacgcgaaaccagcttcattactaacggaa gctgcttagcatcgcggaaaaccagttttatgatggccctttgcctttc atctatttacgaggaccttaaaatgtatcaagttgaatttaagactatg aacgcgaaactgctaatggatcccaagcgacaaatcttcttgatca aaatatgttggctgttattgatgaactgatgcaagccctgaattttaact cagaaaccgtacctcagaaatcgagtttagaagaacccgatttctac aaaactaaaatcaagttgtgtatccttttacatgccttccggattcggg ccgtcactattgatcgcgtgatgtcgtacttgaatgcctcctaa |
| murine IL-12b construct with a N terminal PhoA secretion tag (tag in bold) SEQ ID NO: 956 | atgaaacagagcacgatcgcacttgccctttttgccgctgttattt accccagtgacgaaagccatgtgggaattggaaaaagacgtgtat gttgttgaagttgactggactccggacgcgcctggtgaaactgttaa tctgacttgtgatacaccggaggaagatgatataacttggactagcg atcaacgacacgcgtaatcggctctggtaagactttgaccattact gtgaaggaattcttggatgcggggcaatatacgtgtcataaaggcg gcgagacgctgtcacactctcacctgttgttacataaaaaagagaat ggtatatggtctacggagatcttgaaaaactttaaaaacaaaacttttt tgaagtgtgaggctccaaactattctggtcgctttacctgtagttggtt ggtgcaacgtaacatggatctcaaatttaacataaagtcgtcttcgtct tctcccgatagccgagcggttacctgtggcatggctagtttgtcggc ggagaaggtgaccttggatcaacgtgattatgaaaaatatagcgttt cgtgccaagaggacgttacgtgccctaccgctgaagagactttgcc gattgaattggcactggaagcacgacaacaaaataaatacgagaat tactcaactagtttcttcatccgagatatcataaaaccggacccccg aagaatctgcaaatgaaaccgcttaaaaattcacaggtagaggtttc gtgggagtacccggatagttggtctacgcctcattcgtatttagcct gaaattttcgttcgaatacagcgaaaaaaagagaagatgaaagaa actgaagaagggtgtaaccaaaaaggtgcatttctggtggagaaaa ctagcaccgaggttcaatgcaaaggcggtaacgtgtgcgtacaag ctcaagaccgttattataacagtagctgttctaaatgggcttgcgtgc cctgccgcgtgagatcatga |
| human Il-15 construct with a N terminal PhoA secretion tag (tag in bold) SEQ ID NO: 957 | atgaagcaatctacgatcgcactagcgttactgccgttattgttt actcctgtgactaaggctaattgggttaatgttatatctgatttgaaa aaaatagaggatctgattcaatcaatgcacatagatgcgactctgtat actgagagcgatgtgcacccgagttgcaaagttactgctatgaaatg ttttctgctggagctgcaagttatctctctggagagtggtgatgcgtct attcacgatactgttgagaatctgattattctggctaataactcgctgtc aagtaatgggaatgttacggaatctggctgtaaggagtgtgaagaat tagaagaaaaaaatattaaagagtttctgcagagttttgtgcacattgt tcagatgtttatcaatactagctga |
| human GMCSF construct with a N terminal PhoA secretion tag (tag in bold) SEQ ID NO: 958 | atgaagcaatctacgatcgcgttggccttactgccctgttattc acacccgtgaccaaagcggcaccggcccgcagcccatcaccgt caactcaaccttgggaacatgtaaatgctattcaagaagctcgccgc ctgttgaatttgagtcgcgatactgcagcagagatgaatgagactgt agaggtgatttcagaaatgtttgacctgcaggagccgacttgttgca aactcgcctggagctgtacaaacaaggcctgcgtggctcgctgact aaactgaaaggtcctctgacgatgatggcttctcattataaacaacac tgcccgcctactccggagacgtcttgcgcgacccagataattactttt gaatcttttaaagagaatctgaaagactttctgctggttatcccgtttga ttgttgggaaccggttcaagaataa |
| human TNFa construct with a N terminal PhoA secretion tag (tag in bold) SEQ ID NO: 959 | atgaaacaatcaacgatcgctctggctctgcttccgctgctcttt actccagttactaaagcgggtccgcagagggaagaattcccgcg cgatttgagcctgattcacctcttgctcaggctgtccgctcctcttcg cgtacccccctcggataaacctgtcgcacgtggttgcgaaccgc aagcggaagggcagctgcaatggttaaaccgccgggctaatgca ctgctggctaatggagttgagttacgcgacaaccaacttgtcgttcct tcggaagggctgtatctgatctattcacaggttctctttaaagggcag ggttgcccatcaacccacgtgctcctgacacacacgatcagtcgtat cgcgggtatcctatcagacgaaagttaacctcctgtcagcgattaaat cgccgtgtcagagagaaactccagagggtgcggaagctaaaccg tggtatgaacctatttatcttggtgtgagttttccagttggaaaaaggtg atagactgtcggcagagatcaatcgccctgattacctggatttcgct gagtcgggtcaggtttatttcggaattattgcactgtga |

TABLE 103-continued

Non-limiting Examples of Secretion Constructs

| Description | Sequence |
| --- | --- |
| human IFNg construct with a N terminal PhoA secretion tag (tag in bold) SEQ ID NO: 960 | atgaagcaatctacgatagcactggcgttgctgccgctgctgtt caccccggttaccaaggcgcaggatccttacgttaaagaagcaga gaatctgaaaaaatactttaatgcaggccacagcgatgtggcagat aatggcacgttattcctgggcattctgaaaaattggaaagaagaatct gaccggaagatcatgcaatctcagatcgtatcattttatttcaagttgtt taaaaacttcaaggatgaccagtcgattcaaaaatcagtggaaacg atcaaagaagatatgaacgttaagttcttcaactcaaataaaaaaaaa cgcgatgatttcgaaaaactgactaattattcggtaactgatttgaatg ttcagcgcaaggcgattcatgaattgattcaggttatggcagaactgt cgccagcggcaaaaacgggtaaacgaaaacgttctcagatgttgtt tcgtggttga |

In some embodiments, genetically engineered bacteria comprise a nucleic acid sequence that is at least about 80%, at least about 85%, at least about 90%, at least about 95%, or at least about 99% homologous to the DNA sequence of SEQ ID NO: 920, SEQ ID NO: 921, SEQ ID NO: 922, SEQ ID NO: 923, SEQ ID NO: 924, SEQ ID NO: 925, SEQ ID NO: 926, SEQ ID NO: 927, SEQ ID NO: 928, SEQ ID NO: 929, SEQ ID NO: 930, SEQ ID NO: 931, SEQ ID NO: 932, SEQ ID NO: 933, SEQ ID NO: 934, SEQ ID NO: 935, SEQ ID NO: 936, SEQ ID NO: 937, SEQ ID NO: 938, SEQ ID NO: 939, SEQ ID NO: 940, SEQ ID NO: 941, SEQ ID NO: 942, SEQ ID NO: 943, SEQ ID NO: 944, SEQ ID NO: 945, SEQ ID NO: 946, SEQ ID NO: 947, SEQ ID NO: 948, SEQ ID NO: 949, SEQ ID NO: 950, SEQ ID NO: 951, SEQ ID NO: 952, SEQ ID NO: 953, SEQ ID NO: 954, SEQ ID NO: 955, SEQ ID NO: 956, SEQ ID NO: 957, SEQ ID NO: 958, SEQ ID NO: 959, SEQ ID NO: 960, SEQ ID NO: 961, SEQ ID NO: 962, SEQ ID NO: 963, and SEQ ID NO: 964. Table 105 lists exemplary secretion constructs.

TABLE 104

Sequence Features Legend for Non-limiting Examples of Secretion Constructs

| Font | Feature |
| --- | --- |
| UPPERCASE: | TetR Repressor Coding Sequence |
| *lowercase italic* | TetA/TetR Promoter |
| lowercase underline | Ribosome Binding Site (RBS) |
| BOLD UPPERCASE | PhoA Secretion Signal |
| BOLD UNDERLINE UPPERCASE | Therapeutic Coding Sequence |
| bold lowercase | Transcriptional Terminator |

TABLE 105

Non-limiting Examples of Secretion Constructs

| Description | Sequences |
| --- | --- |
| Ptet.phoA-hIL12b-phoA-hIL12a SEQ ID NO: 965 | ccaggatacatagattaccacaactccgagcccttccaccTTAAGACCCACTT TCACATTTAAGTTGTTTTTCTAATCCGCATATGATCAA TTCAAGGCCGAATAAGAAGGCTGGCTCTGCACCTTGG TGATCAAATAATTCGATAGCTTGTCGTAATAATGGCG GCATACTATCAGTAGTAGGTGTTTCCCTTTCTTCTTTA GCGACTTGATGCTCTTGATCTTCCAATACGCAACCTA AAGTAAAATGCCCCACAGCGCTGAGTGCATATAATGC ATTCTCTAGTGAAAAACCTTGTTGGCATAAAAAGGCT AATTGATTTTCGAGAGTTTCATACTGTTTTTCTGTAGG CCGTGTACCTAAATGTACTTTTGCTCCATCGCGATGAC TTAGTAAAGCACATCTAAAACTTTTAGCGTTATTACGT AAAAAATCTTGCCAGCTTTCCCCTTCTAAAGGGCAAA AGTGAGTATGGTGCCTATCTAACATCTCAATGGCTAA GGCGTCGAGCAAAGCCCGCTTATTTTTTACATGCCAA TACAATGTAGGCTGCTCTACACCTAGCTTCTGGGCGA GTTTACGGGTTGTTAAACCTTCGATTCCGACCTCATTA AGCAGCTCTAATGCGCTGTTAATCACTTTACTTTTATC TAATCTAGACATCAT*taattcctaattttgttgacactctatcattgatagag ttattttaccactccctatcagtgatagagaaaagtgaa*ataagtcataaatagggagtc caaaATGAAGCAGAGCACGATCGCATTGGCGTTGCT ACCGCTGTTGTTTACCCCGGTCACAAAAGCCATCT GGGAACTGAAAAAAGATGTTTATGTAGTTGAACTG GATTGGTACCCGGATGCACCCGGTGAGATGGTGG TTTTGACCTGCGACACGCCGGAAGAAGATGGCATA ACGTGGACCCTGGATCAAAGCTCTGAAGTTCTGGG TTCAGGTAAGACATTGACGATCCAAGTAAAAGAAT TTGGCGACGCAGGTCAGTACACCTGCCACAAAGGT GGCGAAGTTCTGTCGCACTCACTCCTGCTCCTGCA CAAAAAAGAGGATGGCATCTGGAGTACTGATATCC TAAAGGATCAAAAAGAACCTAAAAACAAAACGTTC TTGCGCTGTGAAGCGAAGAACTATAGTGGTCGCTT TACGTGCTGGTGGTTGACTACCATTTCCACCGATT TGACCTTTTCTGTTAAGAGTTCGCGCGGCTCGTCA GATCCGCAGGGCGTTACTTGCGGTGCGGCGACGC |

TABLE 105-continued

Non-limiting Examples of Secretion Constructs

| Description | Sequences |
|---|---|
| | TGTCAGCTGAGAGAGTTCGTGGGGACAACAAAGA<br>GTACGAATATAGTGTAGAATGTCAAGAGGATTCGG<br>CGTGCCCGGCAGCAGAGGAGTCTCTCCCCATTGAA<br>GTTATGGTGGACGCAGTGCATAAACTGAAATATGA<br>GAATTACACATCAAGCTTTTTTATTCGCGATATCAT<br>CAAACCGGATCCTCCAAAAAATCTGCAACTAAAGC<br>CCCTGAAAAATTCGCGCCAAGTTGAGGTGAGCTGG<br>GAATATCCGGATACTTGGTCGACACCGCATTCTTA<br>TTTCTCACTGACCTTCTGCGTTCAGGTTCAAGGTA<br>AATCAAAACGAGAAAAAAAGGATCGCGTCTTTACC<br>GACAAAACGTCTGCTACTGTAATCTGCCGCAAGAA<br>TGCGTCAATTTCTGTACGTGCGCAAGATCGCTACT<br>ACTCTAGTAGTTGGTCTGAATGGGCTTCAGTGCCA<br>TGCTCCTGATGAgaaaccctacggaggaggttaatttATGAAACA<br>GAGCACAATTGCTCTGGCCTTGTTGCCATTACTGT<br>TTACCCCTGTTACTAAGGCTAGGAACCTGCCTGTG<br>GCAACACCAGACCCTGGGATGTTCCCTTGCTTACA<br>TCATTCCCAGAACCTGTTGCGTGCGGTGTCTAACA<br>TGCTGCAGAAAGCCAGGCAGACGCTGGAATTCTAC<br>CCATGCACTTCCGAAGAGATAGATCATGAAGACAT<br>TACGAAAGACAAAACCTCAACGGTTGAAGCATGCT<br>TACCTCTGGAATTGACTAAGAATGAATCGTGCTTA<br>AACTCAAGAGAGACCAGTTTCATCACTAATGGCTC<br>TTGCTTAGCGTCGCGCAAGACCAGCTTCATGATGG<br>CGCTCTGCCTAAGTAGCATCTACGAGGACCTCAAA<br>ATGTACCAAGTTGAATTTAAAACTATGAATGCCAA<br>ACTTCTAATGGACCCAAAAAGACAGATATTTTTAG<br>ATCAGAATATGCTTGCGGTTATTGACGAACTCATG<br>CAGGCATTGAATTTTAATTCCGAGACGGTGCCACA<br>AAAAAGTTCTTTGGAGGAGCCGGACTTTTACAAGA<br>CAAAAATCAAGCTGTGCATACTTCTTCACGCATTC<br>AGAATACGGGCCGTTACGATCGATCGCGTCATGTC<br>GTATCTTAATGCGAGCTGAaaataaaacgaaaggctcagtcgaa<br>agactgggcctttcgttttatctgttggttccttatcatctggcgaatcggacccacaaga<br>gcactg |
| Ptet.phoA-mIL12b-phoA-mIL12a<br>SEQ ID NO: 966 | ccaggatacatagattaccacaactccgagcccttccaccTTAAGACCCACTT<br>TCACATTTAAGTTGTTTTTCTAATCCGCATATGATCAA<br>TTCAAGGCCGAATAAGAAGGCTGGCTCTGCACCTTGG<br>TGATCAAATAATTCGATAGCTTGTCGTAATAATGGCG<br>GCATACTATCAGTAGTAGGTGTTTCCCTTTCTTCTTTA<br>GCGACTTGATGCTCTTGATCTTCCAATACGCAACCTA<br>AAGTAAAATGCCCCACAGCGCTGAGTGCATATAATGC<br>ATTCTCTAGTGAAAAACCTTGTTGGCATAAAAAGGCT<br>AATTGATTTTCGAGAGTTTCATACTGTTTTTCTGTAGG<br>CCGTGTACCTAAATGTACTTTTGCTCCATCGCGATGAC<br>TTAGTAAAGCACATCTAAAACTTTTAGCGTTATTACGT<br>AAAAAAATCTTGCCAGCTTTCCCCTTCTAAAGGGCAAA<br>AGTGAGTATGGTGCCTATCTAACATCTCAATGGCTAA<br>GGCGTCGAGCAAAGCCCGCTTATTTTTTACATGCCAA<br>TACAATGTAGGCTGCTCTACACCTAGCTTCTGGGCGA<br>GTTTACGGGTTGTTAAACCTTCGATTCCGACCTCATTA<br>AGCAGCTCTAATGCGCTGTTAATCACTTTACTTTTATC<br>TAATCTAGACATCATtaattcctaattttgttgacactctatcattgatagag<br>ttattttaccactccctatcagtgatagagaaaagtgaatgttacacatctaaggagaaa<br>cattATGAAACAGAGCACGATCGCACTTGCCCTTTTG<br>CCGCTGTTATTTACCCCAGTGACGAAAGCCATGTG<br>GGAATTGGAAAAAGACGTGTATGTTGTTGAAGTTG<br>ACTGGACTCCGGACGCGCCTGGTGAAACTGTTAAT<br>CTGACTTGTGATACACCGGAGGAAGATGATATAAC<br>TTGGACTAGCGATCAACGACACGGCGTAATCGGCT<br>CTGGTAAGACTTTGACCATTACTGTGAAGGAATTC<br>TTGGATGCGGGCAATATACGTGTCATAAAGGCGG<br>CGAGACGCTGTCACACTCTCACCTGTTGTTACATA<br>AAAAAGAGAATGGTATATGGTCTACGGAGATCTTG<br>AAAAACTTTAAAAACAAAACTTTTTTGAAGTGTGA<br>GGCTCCAAACTATTCTGGTCGCTTTACCTGTAGTT<br>GGTTGGTGCAACGTAACATGGATCTCAAATTTAAC<br>ATAAAGTCGTCTTCGTCTTCTCCCGATAGCCGAGC<br>GGTTACCTGTGGCATGGCTAGTTTGTCGGCGGAGA<br>AGGTGACCTTGGATCAACGTGATTATGAAAAATAT<br>AGCGTTTCGTGCCAAGAGGACGTTACGTGCCCTAC<br>CGCTGAAGAGACTTTGCCGATTGAATTGGCACTGG<br>AAGCACGACAACAAAATAAATACGAGAATTACTCA<br>ACTAGTTTCTTCATCCGAGATATCATAAAACCGGA<br>CCCCCCGAAGAATCTGCAAATGAAACCGCTTAAAA |

TABLE 105-continued

Non-limiting Examples of Secretion Constructs

| Description | Sequences |
|---|---|
| | ATTCACAGGTAGAGGTTTCGTGGGAGTACCCGGAT<br>AGTTGGTCTACGCCTCATTCGTATTTTAGCCTGAA<br>ATTTTTCGTTCGAATACAGCGAAAAAAAGAGAAGA<br>TGAAAGAAACTGAAGAAGGGTGTAACCAAAAAGGT<br>GCATTTCTGGTGGAGAAAACTAGCACCGAGGTTCA<br>ATGCAAAGGCGGTAACGTGTGCGTACAAGCTCAAG<br>ACCGTTATTATAACAGTAGCTGTTCTAAATGGGCT<br>TGCGTGCCCTGCCGCGTGAGATCATGAgaagaagattattg<br>aagaggtccgcATGAAACAGAGTACGATAGCCCTAGCCC<br>TGTTGCCGCTCCTGTTCACCCCCGTTACTAAAGCA<br>CGTAACCTTCCGGTGGCCACGCCAGATCCGGGCAT<br>GTTCCCGTGCTTACACCATTCCCAGAATCTGCTGC<br>GCGCTGTGAGTAATATGCTGCAGAAGGCGAGACA<br>AACTTTGGAATTTTACCCGTGCACTTCGGAGGAGA<br>TTGACCATGAGGATATCACAAAAGACAAAACCAGT<br>ACAGTGGAAGCCTGCCTGCCCCTTGAACTGACTAA<br>AAATGAGAGTTGTTTAAATTCACGCGAAACCAGCT<br>TCATTACTAACGGAAGCTGCTTAGCATCGCGGAAA<br>ACCAGTTTTATGATGGCCCTTTGCCTTTCATCTATT<br>TACGAGGACCTTAAAATGTATCAAGTTGAATTTAA<br>GACTATGAACGCGAAACTGCTAATGGATCCCAAGC<br>GACAAATCTTTCTTGATCAAAATATGTTGGCTGTTA<br>TTGATGAACTGATGCAAGCCCTGAATTTTAACTCA<br>GAAACCGTACCTCAGAAATCGAGTTTAGAAGAACC<br>CGATTTCTACAAAACTAAAATCAAGTTGTGTATCCT<br>TTTACATGCCTTCCGGATTCGGGCCGTCACTATTG<br>ATCGCGTGATGTCGTACTTGAATGCCTCCTAAaaata<br>aaacgaaaggctcagtcgaaagactgggcctttcgttttatctgttggttccttatcatc<br>tggcgaatcggacccacaagagcactg |
| Ptet.phoA-IL15<br>SEQ ID NO: 967 | ccaggatacatagattaccacaactccgagcccttccaccTTAAGACCCACTT<br>TCACATTTAAGTTGTTTTTCTAATCCGCATATGATCAA<br>TTCAAGGCCGAATAAGAAGGCTGGCTCTGCACCTTGG<br>TGATCAAATAATTCGATAGCTTGTCGTAATAATGGCG<br>GCATACTATCAGTAGTAGGTGTTTCCCTTTCTTCTTTA<br>GCGACTTGATGCTCTTGATCTTCCAATACGCAACCTA<br>AAGTAAAATGCCCCACAGCGCTGAGTGCATATAATGC<br>ATTCTCTAGTGAAAAACCTTGTTGGCATAAAAAGGCT<br>AATTGATTTTCGAGAGTTTCATACTGTTTTTCTGTAGG<br>CCGTGTACCTAAATGTACTTTTGCTCCATCGCGATGAC<br>TTAGTAAAGCACATCTAAAACTTTTAGCGTTATTACGT<br>AAAAAATCTTGCCAGCTTTCCCCTTCTAAAGGGCAAA<br>AGTGAGTATGGTGCCTATCTAACATCTCAATGGCTAA<br>GGCGTCGAGCAAAGCCCGCTTATTTTTTACATGCCAA<br>TACAATGTAGGCTGCTCTACACCTAGCTTCTGGGCGA<br>GTTTACGGGTTGTTAAACCTTCGATTCCGACCTCATTA<br>AGCAGCTCTAATGCGCTGTTAATCACTTTACTTTTATC<br>TAATCTAGACATCATtaattcctaattttttgttgacactctatcattgatagag<br>ttattttaccactccctatcagtgatagagaaaagtgaagatcaactcaagataaggag<br>gatccATGAAGCAATCTACGATCGCACTAGCGTTACT<br>GCCGTTATTGTTTACTCCTGTGACTAAGGCTAATT<br>GGGTTAATGTTATATCTGATTTGAAAAAAAATAGAG<br>GATCTGATTCAATCAATGCACATAGATGCGACTCT<br>GTATACTGAGAGCGATGTGCACCCGAGTTGCAAAG<br>TTACTGCTATGAAATGTTTTCTGCTGGAGCTGCAA<br>GTTATCTCTCTGGAGAGTGGTGATGCGTCTATTCA<br>CGATACTGTTGAGAATCTGATTATTCTGGCTAATA<br>ACTCGCTGTCAAGTAATGGGAATGTTACGGAATCT<br>GGCTGTAAGGAGTGTGAAGAATTAGAAGAAAAAAA<br>TATTAAAGAGTTTCTGCAGAGTTTTGTGCACATTG<br>TTCAGATGTTTATCAATACTAGCTGAaaataaaacgaaag<br>gctcagtcgaaagactgggcctttcgttttatctgttggttccttatcatctggcgaatcg<br>gacccacaagagcactg |
| Ptet.phoA-GMCSF<br>SEQ ID NO: 968 | ccaggatacatagattaccacaactccgagcccttccaccTTAAGACCCACTT<br>TCACATTTAAGTTGTTTTTCTAATCCGCATATGATCAA<br>TTCAAGGCCGAATAAGAAGGCTGGCTCTGCACCTTGG<br>TGATCAAATAATTCGATAGCTTGTCGTAATAATGGCG<br>GCATACTATCAGTAGTAGGTGTTTCCCTTTCTTCTTTA<br>GCGACTTGATGCTCTTGATCTTCCAATACGCAACCTA<br>AAGTAAAATGCCCCACAGCGCTGAGTGCATATAATGC<br>ATTCTCTAGTGAAAAACCTTGTTGGCATAAAAAGGCT<br>AATTGATTTTCGAGAGTTTCATACTGTTTTTCTGTAGG<br>CCGTGTACCTAAATGTACTTTTGCTCCATCGCGATGAC<br>TTAGTAAAGCACATCTAAAACTTTTAGCGTTATTACGT<br>AAAAAATCTTGCCAGCTTTCCCCTTCTAAAGGGCAAA |

TABLE 105-continued

Non-limiting Examples of Secretion Constructs

| Description | Sequences |
|---|---|
| | AGTGAGTATGGTGCCTATCTAACATCTCAATGGCTAA<br>GGCGTCGAGCAAAGCCCGCTTATTTTTTACATGCCAA<br>TACAATGTAGGCTGCTCTACACCTAGCTTCTGGGCGA<br>GTTTACGGGTTGTTAAACCTTCGATTCCGACCTCATTA<br>AGCAGCTCTAATGCGCTGTTAATCACTTTACTTTTATC<br>TAATCTAGACATCAT*taattcctaattttgttgacactctatcattgatagag*<br>*ttattttaccactccctatcagtgatagagaaaagtgaa*gaaagcaacaacatagggggaaaga*ATGAAGCAATCTACGATCGCGTTGGCCTTACT<br><u>GCCCCTGTTATTCACACCCGTGACCAAAGCGG</u>CAC<br><u>CGGCCCGCAGCCCATCACCGTCAACTCAACCTTGG</u><br><u>GAACATGTAAATGCTATTCAAGAAGCTCGCCGCCT</u><br><u>GTTGAATTTGAGTCGCGATACTGCAGCAGAGATGA</u><br><u>ATGAGACTGTAGAGGTGATTTCAGAAATGTTTGAC</u><br><u>CTGCAGGAGCCGACTTGTTTGCAAACTCGCCTGGA</u><br><u>GCTGTACAAACAAGGCCTGCGTGGCTCGCTGACTA</u><br><u>AACTGAAAGGTCCTCTGACGATGATGGCTTCTCAT</u><br><u>TATAAACAACACTGCCCGCCTACTCCGGAGACGTC</u><br><u>TTGCGCGACCCAGATAATTACTTTTGAATCTTTTA</u>A<br>AGAGAATCTGAAAGACTTTCTGCTGGTTATCCCGT<br><u>TTGATTGTTGGGAACCGGTTCAAGAATAA</u>aaataaaac<br>gaaaggctcagtcgaaagactgggcctttcgttttatctgttggttccttatcatctggc<br>gaatcggacccacaagagcactg |
| Ptet-phoA-TNFa<br>SEQ ID NO: 969 | ccaggatacatagattaccacaactccgagcccttccaccTTAAGACCCACTT<br>TCACATTTAAGTTGTTTTTCTAATCCGCATATGATCAA<br>TTCAAGGCCGAATAAGAAGGCTGGCTCTGCACCTTGG<br>TGATCAAATAATTCGATAGCTTGTCGTAATAATGGCG<br>GCATACTATCAGTAGTAGGTGTTTCCCTTTCTTCTTTA<br>GCGACTTGATGCTCTTGATCTTCCAATACGCAACCTA<br>AAGTAAAATGCCCCACAGCGCTGAGTGCATATAATGC<br>ATTCTCTAGTGAAAAACCTTGTTGGCATAAAAAGGCT<br>AATTGATTTTCGAGAGTTTCATACTGTTTTTCTGTAGG<br>CCGTGTACCTAAATGTACTTTTGCTCCATCGCGATGAC<br>TTAGTAAAGCACATCTAAAACTTTTAGCGTTATTACGT<br>AAAAAATCTTGCCAGCTTTCCCCTTCTAAAGGGCAAA<br>AGTGAGTATGGTGCCTATCTAACATCTCAATGGCTAA<br>GGCGTCGAGCAAAGCCCGCTTATTTTTTACATGCCAA<br>TACAATGTAGGCTGCTCTACACCTAGCTTCTGGGCGA<br>GTTTACGGGTTGTTAAACCTTCGATTCCGACCTCATTA<br>AGCAGCTCTAATGCGCTGTTAATCACTTTACTTTTATC<br>TAATCTAGACATCAT*taattcctaattttgttgacactctatcattgatagag*<br>*ttattttaccactccctatcagtgatagagaaaagtgaa*cacaacacagaaggaggg<br>ctgtccATGAAACAATCAACGATCGCTCTGGCTCTGCT<br><u>TCCGCTGCTCTTTACTCCAGTTACTAAAGCGGGTC</u><br><u>CGCAGAGGGAAGAATTCCCGCGCGATTTGAGCCT</u><br><u>GATTTCACCTCTTGCTCAGGCTGTCCGCTCCTCTT</u><br><u>CGCGTACCCCCTCGGATAAACCTGTCGCGCACGTG</u><br><u>GTTGCGAACCCGCAAGCGGAAGGGCAGCTGCAAT</u><br><u>GGTTAAACCGCCGGGCTAATGCACTGCTGGCTAAT</u><br><u>GGAGTTGAGTTACGCGACAACCAACTTGTCGTTCC</u><br><u>TTCGGAAGGGCTGTATCTGATCTATTCACAGGTTC</u><br><u>TCTTTAAAGGGCAGGGTTGCCCATCAACCCACGTG</u><br><u>CTCCTGACACACACGATCAGTCGTATCGCGGTATC</u><br><u>CTATCAGACGAAAGTTAACCTCCTGTCAGCGATTA</u><br><u>AATCGCCGTGTCAGAGAGAAACTCCAGAGGGTGC</u><br><u>GGAAGCTAAACCGTGGTATGAACCTATTTATCTTG</u><br><u>GTGGAGTTTTCCAGTTGGAAAAAGGTGATAGACTG</u><br><u>TCGGCAGAGATCAATCGCCCTGATTACCTGGATTT</u><br><u>CGCTGAGTCGGGTCAGGTTTATTTCGGAATTATTG</u><br><u>CACTGTGA</u>aaataaaacgaaaggctcagtcgaaagactgggcctttcgtttt<br>atctgttggttccttatcatctggcgaatcggacccacaagagcactg |
| Ptet-phoA-IFNg<br>SEQ ID NO: 970 | ccaggatacatagattaccacaactccgagcccttccaccTTAAGACCCACTT<br>TCACATTTAAGTTGTTTTTCTAATCCGCATATGATCAA<br>TTCAAGGCCGAATAAGAAGGCTGGCTCTGCACCTTGG<br>TGATCAAATAATTCGATAGCTTGTCGTAATAATGGCG<br>GCATACTATCAGTAGTAGGTGTTTCCCTTTCTTCTTTA<br>GCGACTTGATGCTCTTGATCTTCCAATACGCAACCTA<br>AAGTAAAATGCCCCACAGCGCTGAGTGCATATAATGC<br>ATTCTCTAGTGAAAAACCTTGTTGGCATAAAAAGGCT<br>AATTGATTTTCGAGAGTTTCATACTGTTTTTCTGTAGG<br>CCGTGTACCTAAATGTACTTTTGCTCCATCGCGATGAC<br>TTAGTAAAGCACATCTAAAACTTTTAGCGTTATTACGT<br>AAAAAATCTTGCCAGCTTTCCCCTTCTAAAGGGCAAA<br>AGTGAGTATGGTGCCTATCTAACATCTCAATGGCTAA<br>GGCGTCGAGCAAAGCCCGCTTATTTTTTACATGCCAA |

TABLE 105-continued

Non-limiting Examples of Secretion Constructs

| Description | Sequences |
|---|---|
| | TACAATGTAGGCTGCTCTACACCTAGCTTCTGGGCGA<br>GTTTACGGGTTGTTAAACCTTCGATTCCGACCTCATTA<br>AGCAGCTCTAATGCGCTGTTAATCACTTTACTTTTATC<br>TAATCTAGACATCATtaattcctaattttgttgacactctatcattgatagag<br>ttattttaccactccctatcagtgatagagaaaagtgaacaccaccaccacgaggaggt<br>aaaaaATGAAGCAATCTACGATAGCACTGGCGTTGCT<br>GCCGCTGCTGTTCACCCCGGTTACCAAGGCGCAGG<br>ATCCTTACGTTAAAGAAGCAGAGAATCTGAAAAAA<br>TACTTTAATGCAGGCCACAGCGATGTGGCAGATAA<br>TGGCACGTTATTCCTGGGCATTCTGAAAAATTGGA<br>AAGAAGAATCTGACCGGAAGATCATGCAATCTCAG<br>ATCGTATCATTTTATTTCAAGTTGTTTAAAAACTTC<br>AAGGATGACCAGTCGATTCAAAAATCAGTGGAAAC<br>GATCAAAGAAGATATGAACGTTAAGTTCTTCAACT<br>CAAATAAAAAAAAACGCGATGATTTCGAAAAACTG<br>ACTAATTATTCGGTAACTGATTTGAATGTTCAGCG<br>CAAGGCGATTCATGAATTGATTCAGGTTATGGCAG<br>AACTGTCGCCAGCGGCAAAAACGGGTAAACGAAA<br>ACGTTCTCAGATGTTGTTTCGTGGTTGAaaataaaacga<br>aaggctcagtcgaaagactgggcctttcgttttatctgttggttccttatcatctggcga<br>atcggacccacaagagcactg |

In some embodiments, genetically engineered bacteria comprise a nucleic acid sequence that is at least about 80%, at least about 85%, at least about 90%, at least about 95%, or at least about 99% homologous to the DNA sequence of SEQ ID NO: 965, SEQ ID NO: 966, SEQ ID NO: 967, SEQ ID NO: 968, SEQ ID NO: 969, SEQ ID NO: 970, SEQ ID NO: 971, SEQ ID NO: 972, SEQ ID NO: 973, and SEQ ID NO: 974.

Example 49. Cytokine Secretion (mIL-12 and hIL-12)

To determine whether the mIL-12 and hIL-12 expressed by engineered bacteria is secreted, the concentration of IL-12 in the bacterial supernatant from engineered strains comprising mIL-12 or hIL-12 secretion constructs/strains was measured. The strains comprise either a deletion in Lpp (lpp::Cm), nlpI (nlpI::Cm), tolA (tolA::Cm), or PAL (PAL::Cm). All strains further comprise a either a plasmid expressing hIL-12 with a PhoA secretion tag or a plasmid expressing mIL-12 with a PhoA secretion tag from a tetracycline-inducible promoter (Table 107 and Table 106).

E. coli Nissle strains were grown overnight in LB medium. Cultures were diluted 1:200 in LB and grown shaking (200 rpm) for 2 hours. Cultures were diluted to an optical density of 0.5 at which time anhydrous tetracycline (ATC) was added to cultures at a concentration of 100 ng/mL to induce expression of hIL-12. After 12 hours of induction, cells were spun down, and supernatant was collected. To generate cell free medium, the clarified supernatant was further filtered through a 0.22 micron filter to remove any remaining bacteria and placed on ice. Additionally, to detect intracellular recombinant protein production, pelleted were bacteria washed and resuspended in Bug-Buster™ (Millipore) with protease inhibitors and Ready-Lyse Lysozyme Solution (Epicentre), resulting in lysate concentrated 10-fold compared to original culture conditions. After incubation at room temperature for 10 minutes insoluble debris is spun down at 20 min at 12,000 rcf at 4.0 then placed on ice until further processing.

The concentration of mIL-12 or hIL-12 in the cell-free medium and in the bacterial cell extract was measured by mIL-12 ELISA (RnD Systems, Minneapolis, Minn.) or hIL-12 ELISA (RnD Systems, Minneapolis, Minn.), according to manufacturer's instructions. All samples were run in triplicate, and a standard curve was used to calculate secreted levels of mIL-12 or hIL-12. Standard curves were generated using recombinant mIL-12 or hIL-12. Wild type Nissle was included in the ELISA as a negative control, and no signal was observed. Table 106 and Table 107 summarize levels of mIL-12 and hIL-12 measured in the respective supernatants. The data show that both mIL-12 and h-IL-12 are secreted at various levels from the different bacterial strains.

TABLE 106

Concentration of mIL-12 secreted into the media

| ID | Genotype | Construct | [mIL-12] (ng/ml) in the medium |
|---|---|---|---|
| SYN1825 | Lpp (lpp::Cm) | pBR322.Ptet.phoA-mIL12 | 0.2 |
| SYN1826 | nlpI (nlpI::Cm) | pBR322.Ptet.phoA-mIL12 | 0.1 |
| SYN1827 | tolA (tolA::Cm) | pBR322.Ptet.phoA-mIL12 | 0.1 |
| SYN1828 | PAL (PAL::Cm) | pBR322.Ptet.phoA-mIL12 | 0.3 |

TABLE 107

Concentration of Secreted hIL-12

| ID | Genotype | Construct | [hIL-12] (ng/ml) in the medium |
|---|---|---|---|
| SYN1821 | Lpp (lpp::Cm) | pBR322.Ptet.phoA-hIL12 | 0.9 |
| SYN1822 | nlpI (nlpI::Cm) | pBR322.Ptet.phoA-hIL12 | 0.5 |
| SYN1823 | tolA (tolA::Cm) | pBR322.Ptet.phoA-hIL12 | 0.5 |
| SYN1824 | PAL (PAL::Cm) | pBR322.Ptet.phoA-hIL12 | 0.3 |

Example 50. Cytokine Secretion (IL-15)

To determine whether the hIL-15 expressed by engineered bacteria is secreted, the concentration of hIL-15 in the bacterial supernatant from engineered strains comprising hIL-15 secretion constructs/strains was measured. The strains comprise either a deletion in Lpp (lpp::Cm), nlpI (nlpI::Cm), tolA (tolA::Cm), or PAL (PAL::Cm). All strains further comprise a plasmid expressing hIL-15 with a PhoA secretion tag (Table 108).

E. coli Nissle strains were grown, induced and processed as described in the previous example for hIL12 and hIL-12.

The concentration of hIL-15 in the cell-free medium and in the bacterial cell extract was measured by hIL-15 ELISA (RnD Systems, Minneapolis, Minn.), according to manufacturer's instructions. All samples were run in triplicate, and a standard curve was used to calculate secreted levels of hIL-15. Standard curves were generated using recombinant hIL-15. Wild type Nissle was included in the ELISA as a negative control, and no signal was observed. Table 108 summarizes levels of hIL-15 measured in the respective supernatants. The data show that hIL-15 is secreted at various levels from the different bacterial strains.

TABLE 108

Concentration of Secreted hIL-15

| ID | Genotype | Construct | [IL-15] (ng/ml) in the medium |
|---|---|---|---|
| SYN1817 | Lpp (lpp::Cm) | pBR322.Ptet.phoA-IL15 | 27.9 |
| SYN1818 | nlpI (nlpI::Cm) | pBR322.Ptet.phoA-IL15 | 30.4 |
| SYN1819 | tolA (tolA::Cm) | pBR322.Ptet.phoA-IL15 | 33.8 |
| SYN1820 | PAL (PAL::Cm) | pBR322.Ptet.phoA-IL15 | 38.0 |

Example 51. Cytokine Secretion (GMCSF)

To determine whether hGMCSF expressed by engineered bacteria is secreted, the concentration of hGMCSF in the bacterial supernatant from engineered strains comprising hGMCSF secretion constructs/strains was measured. The strains comprise either a deletion in Lpp (lpp::Cm), nlpI (nlpI::Cm), tolA (tolA::Cm), or PAL (PAL::Cm). All strains further comprise a plasmid expressing hGMCSF with a PhoA secretion tag Table 109).

E. coli Nissle strains were grown, induced and processed as described in the previous example for hIL12 and hIL-12.

The concentration of hGMCSF in the cell-free medium and in the bacterial cell extract was measured by hGMCSF ELISA (RnD Systems, Minneapolis, Minn.), according to manufacturer's instructions. All samples were run in triplicate, and a standard curve was used to calculate secreted levels of hGMCSF. Standard curves were generated using recombinant hGMCSF. Wild type Nissle was included in the ELISA as a negative control, and no signal was observed. Table 109 summarizes levels of hGMCSF measured in the respective supernatants. The data show that hGMCSF is secreted at various levels from the different bacterial strains.

TABLE 109

Concentration of Secreted GMCSF

| ID | Genotype | High copy construct | Low copy construct | [GMCSF] (ng/ml) in the medium High copy plasmid | [GMCSF] (ng/ml) in the medium Low copy plasmid |
|---|---|---|---|---|---|
| SYN094 | WT | None | None | 0.0 | 0.0 |
| SYN2036/SYN2093 | lpp | pUC.Ptet.phoA-GMCSF | pUN UNSX-TetR-Ptet-phoA-GMCSF-UNS9 | 45.8 | 44.7 |
| SYN2038/SYN2103 | PAL | pUC.Ptet.phoA-GMCSF | pUN UNSX-TetR-Ptet-phoA-GMCSF-UNS9 | 114.3 | 98.8 |
| SYN2037/SYN2095 | nlpI | pUC.Ptet.phoA-GMCSF | pUN UNSX-TetR-Ptet-phoA-GMCSF-UNS9 | 39.9 | 44.0 |

Example 52. Cytokine Secretion (TNFa)

To determine whether hTNFa expressed by engineered bacteria is secreted, the concentration of hTNFa in the bacterial supernatant from engineered strains comprising hTNFa secretion constructs/strains was measured. The strains comprise either a deletion in Lpp (lpp::Cm), nlpI (nlpI::Cm), tolA (tolA::Cm), or PAL (PAL::Cm). All strains further comprise a plasmid expressing hTNFa with a PhoA secretion tag (Table 110).

E. coli Nissle strains were grown, induced and processed as described in the previous example for hIL12 and hIL-12.

The concentration of hTNFa in the cell-free medium and in the bacterial cell extract was measured by hTNFa ELISA (RnD Systems, Minneapolis, Minn.), according to manufacturer's instructions. All samples were run in triplicate, and a standard curve was used to calculate secreted levels of hTNFa. Standard curves were generated using recombinant hTNFa. Wild type Nissle was included in the ELISA as a negative control, and no signal was observed. Table 110 summarizes levels of hTNFa measured in the respective supernatants. The data show that hTNFa is secreted at various levels from the different bacterial strains.

TABLE 110

Concentration of Secreted TNFa

| Strain | Genotype | Construct | Secreted [TNFa] ng/mL |
|---|---|---|---|
| SYN094 | WT | None | 0 |
| SYN2541 | lpp::Cm | Nissle Ptet-phoA-TNFa | 129.6 |
| SYN2542 | nlpI::Cm | Nissle Ptet-phoA-TNFa | 345.3 |
| SYN2543 | PAL::Cm | Nissle Ptet-phoA-TNFa | >400 |
| SYN2544 | TrpE PAL::Cm | HA3/4::Plpp-pKYNase Ptet-phoA-TNFa | >400 |
| SYN2545 | TrpE PAL::Cm | HA3/4::PSyn-pKYNase Ptet-phoA-TNFa | >400 |

Example 53. Cytokine Secretion (hIFNg)

To determine whether hIFNg expressed by engineered bacteria is secreted, the concentration of hIFNg in the bacterial supernatant from engineered strains comprising hTNFa secretion constructs/strains was measured. The strains comprise either a deletion in Lpp (lpp::Cm), nlpI (nlpI::Cm), tolA (tolA::Cm), or PAL (PAL::Cm). All strains further comprise a plasmid expressing hIFNg with a PhoA secretion tag (Table 111).

*E. coli* Nissle strains were grown, induced and processed as described in the previous example for hIL12 and hIL-12. The concentration of hIFNg in the cell-free medium and in the bacterial cell extract was measured by hIFNg ELISA (RnD Systems, Minneapolis, Minn.), according to manufacturer's instructions. All samples were run in triplicate, and a standard curve was used to calculate secreted levels of hIFNg. Standard curves were generated using recombinant hIFNg. Wild type Nissle was included in the ELISA as a negative control, and no signal was observed. Table 111 summarizes levels of hIFNg measured in the respective supernatants. The data show that hIFNg is secreted at various levels from the different bacterial strains.

TABLE 111

Concentration of Secreted IFNg

| Strain | Genotype | Construct | Secreted [IFNg] ng/mL |
|---|---|---|---|
| SYN094 | WT | None | 0 |
| SYN2546 | lpp::Cm | Nissle Ptet-phoA-IFNg | 44.9 |
| SYN2547 | nlpI::Cm | Nissle Ptet-phoA-IFNg | 51.5 |
| SYN2548 | PAL::Cm | Nissle Ptet-phoA-IFNg | 85.9 |
| SYN2549 | TrpE PAL::Cm | HA3/4::Plpp-pKYNase Ptet-phoA-IFNg | 39.1 |
| SYN2550 | TrpE PAL::Cm | HA3/4::PSyn-pKYNase Ptet-phoA-IFNg | 87.6 |

Table 112. provides a summary of the levels of secretion obtained for each cytokine, and lists some structural features of the cytokine which may explain some of the differences in secretion levels observed.

TABLE 112

Summary of Secretion Results

| Therapeutic | Size (Dal) | Stoichiometry | O-linked Glycosylation | N-linked Glycosylation | Disulphide Bonds | Secretion level (ng/mL) |
|---|---|---|---|---|---|---|
| hIL-12 | 57238 | Heterodimer | 1 | 4 | 7 | 0.9 |
| mIL-12 | 57496 | Heterodimer | 0 | 5 | 4 | 0.2 |
| hIL-15 | 14715 | Monomer | 0 | 1 | 2 | 38.0 |
| GMCSF | 14477 | Monomer | 4 | 2 | 2 | 114.0 |
| TNF-alpha | 17353 | Monomer | 1 | 0 | 1 | >400 |
| IFN-gamma | 16177 | Homodimer | 0 | 2 | 0 | 87.6 |

Example 54. α-PD1-scFv Expression in *E. coli*

To determine whether a functional scFv can be expressed in *E coli*, an anti-PD1-scFv fragment was generated based on J43 monoclonal antibody, which reacts with mouse PD-1.

Mouse monoclonal antibody J43 sequence was obtained from patent EP 1445264 A1. Next, the single-chain variable fragment (scFv) was designed. A fragment containing tet promoter, a ribosome binding site, the designed J43-scFv, a C terminal V5 tag and a C terminal hexa-histidine tag was synthesized by IDTDNA. The construct was cloned into the pCR™-Blunt II-TOPO® Vector (Invitrogen) and transformed into *E. coli* DH5a as described herein to generate the plasmid pUC-ptet-J43scFv-V5-HIS (SEQ ID NO: 1, shown in Table 113).

TABLE 113

PD1-scFv sequences

| Description | Sequence |
|---|---|
| ptet-J43scFv-V5-HIS (promoter is underlined; V5 tag is in italics, linker is bold) SEQ ID NO: 975 | AGCGCCCAATACGCAAACCGCCTCTCCCCGCGCGTTGGCCGATTCATTAATGCAGCTGGC ACGACAGGTTTCCCGACTGGAAAGCGGGCAGTGAGCGCAACGCAATTAATGTGAGTTAG CTCACTCATTAGGCACCCCAGGCTTTACACTTTATGCTTCCGGCTCGTATGTTGTGTGGAA TTGTGAGCGGATAACAATTTCACACAGGAAACAGCTATGACCATGATTACGCCAAGCTA TTTAGGTGACACTATAGAATACTCAAGCTATGCATCAAGCTTGGTACCGAGCTCGGATCC ACTAGTAACGGCCGCCAGTGTGCTGGAATTCGCCCTTtt aagaccacttt cacatttaa gttgttttt ctaatccgcagatgat caatt caaggccgaat aagaaggctggct ctgcac cttggtgat caaataattcgatagcttgtcgt aat aatggcggcat act atcagt agt a ggtgtttcccttt ctt cttt agcgacttgat gct ctt gat ctt ccaat acgcaacct aa agtaaaatgccccacagcgctgagtgcat at aat gcattctct agt gaaaaaccttgtt ggcat aaaaaggct aattgattttcgagagtttcat act gtttttctgt aggccgtgta cct aaat gt acttttgccat cgcgat gact t agt aaagcacat ct aaaact tttagc gttattacgt aaaaaatcttgccagctttccccttctaaagggcaaaagt gagt atggt gcct atct aacat ctcaat ggctaaggcgtcgagcaaagcccgcttatttttt acat gc caat acaat gt aggctgctct acacct agcttct gggcgagtt tacgggttgtt aaacc ttcgattccgacctcatt aagcagct ctaatgcgctgtt aatcact ttactttt at ct a atct agacat catt aattcct aattttt gttgacact ct atcatt gat agagttatttt |

TABLE 113-continued

PD1-scFv sequences

| Description | Sequence |
|---|---|
| | accactccctatcagtgatagagaaaagtgaaaggaggtaaattatgcaattgGAAGTT<br>CGCCTGTTGGAGAGCGGtGGtGGACTTGTGAAACCCGAGGGAAGCCTTAAACTTTCGTGC<br>GTTGCTAGTGGGTTCACATTTTCAGACTATTTCATGTCCTGGGTCCGTCAAGCCCCGGGA<br>AAAGGACTTGAATGGGTTGCCCATATTTACACCAAGAGCTATAACTATGCCACATACTAT<br>TCTGGAAGCGTTAAAGGTCGTTTTACCATTTCGCGTGACGACAGCCGTTCtATGGTGTATTT<br>GCAGATGAATAACCTTCGTACAGAAGATACGGCTACTTACTACTGTACTCGCGATGGATCAG<br>GCTATCCCAGTTTAGATTTCTGGGGACAGGGTACTCAGGTTACTGTTTCAAGCGGTGGAGGC<br>GGCTCTGGCGGTGGTGGGAGTGGAGGCGGTGGCAGTTACGAGCTGACGCAGCCaCCCTCG<br>GCAAGTGTAAACGTGGGCGAAACGGTGAAAATTACTTGTTCGGGGGATCAACTGCCCAA<br>ATACTTCGCCGATTGGTTTCATCAACGTTCCGATCAGACTATTTTACAAGTGATTTATGAT<br>GATAACAAACGTCCGTCAGGAATCCCAGAGCTATCAGCGGATCGAGCAGCGGAACAAC<br>AGCAACTTTGACCATCCGCGATGTCCGTGCCGAAGACGAGGGGGACTACTATTGTTTCTC<br>TGGATACGTGGACTCAGACAGCAAGCTGTATGTTTTTGGCTCAGGAACACAACTGACCGT<br>ACTGGGCAAGGGCGAGCTCAATTCGAAGCTTGAAGGTAAGCCTATCCCTAACCCTCTCCTC<br>GGcCTCGATTCTACGCGTACCGGTCATCATCACCATCACCATTGAGCATGCGGTCTCaGGA<br>GgAAGGGCGAATTCTGCAGATATCCATCACACTGGCGGCCGCTCGAGCATGCATCTAGA<br>GGGCCCAATTCGCCCTATAGTGAGTCGTATTACAATTCACTGGCCGTCGTTTTACAACGT<br>CGTGACTGGGAAAACCCTGGCGTTACCCAACTTAATCGCCTTGCAGCACATCCCCCTTTC<br>GCCAGCTGGCGTAATAGCGAAGAGGCCCGCACCGATCGCCCTTCCCAACAGTTGCGCAG<br>CCTATACGTACGGCAGTTTAAGGTTTACACCTATAAAAGAGAGAGCCGTTATCGTCTGTT<br>TGTGGATGTACAGAGTGATATTATTGACACGCCGGGGCGACGGATGGTGATCCCCCTGG<br>CCAGTGCACGTCTGCTGTCAGATAAAGTCTCCCGTGAACTTTACCCGGTGGTGCATATCG<br>GGGATGAAAGCTGGCGCATGATGACCACCGATATGGCCAGTGTGCCGGTCTCCGTTATC<br>GGGGAAGAAGTGGCTGATCTCAGCCACCGCGAAAATGACATCAAAAACGCCATTAACCT<br>GATGTTCTGGGGAATATAAATGTCAGGCATGAGATTATCAAAAAGGATCTTCACCTAGA<br>TCCTTTTCACGTAGAAAGCCAGTCCGCAGAAACGGTGCTGACCCCGGATGAATGTCAGCT<br>ACTGGGCTATCTGGACAAGGGAAAACGCAAGCGCAAAGAGAAAGCAGGTAGCTTGCAG<br>TGGGCTTACATGGCGATAGCTAGACTGGGCGGTTTTATGGACAGCAAGCGAACCGGAAT<br>TGCCAGCTGGGGCGCCCTCTGGTAAGGTTGGGAAGCCCTGCAAAGTAAACTGGATGGCT<br>TTCTCGCCGCCAAGGATCTGATGGCGCAGGGGATCAAGCTCTGATCAAGAGACAGGATG<br>AGGATCGTTTCGCATGATTGAACAAGATGGATTGCACGCAGGTTCTCCGGCCGCTTGGGT<br>GGAGAGGCTATTCGGCTATGACTGGGCACAACAGACAATCGGCTGCTCTGATGCCGCCG<br>TGTTCCGGCTGTCAGCGCAGGGGCGCCCGGTTCTTTTTGTCAAGACCGACCTGTCCGGTG<br>CCCTGAATGAACTGCAAGACGAGGCAGCGCGGCTATCGTGGCTGGCCACGACGGGCGTT<br>CCTTGCGCAGCTGTGCTCGACGTTGTCACTGAAGCGGGAAGGGACTGGCTGCTATTGGGC<br>GAAGTGCCGGGGCAGGATCTCCTGTCATCTCACCTTGCTCCTGCCGAGAAAGTATCCATC<br>ATGGCTGATGCAATGCGGCGGCTGCATACGCTTGATCCGGCTACCTGCCCATTCGACCAC<br>CAAGCGAAACATCGCATCGAGCGAGCACGTACTCGGATGGAAGCCGGTCTTGTCGATCA<br>GGATGATCTGGACGAAGAGCATCAGGGGCTCGCGCCAGCCGAACTGTTCGCCAGGCTCA<br>AGGCGAGCATGCCCGACGGCGAGGATCTCGTCGTGACCCATGGCGATGCCTGCTTGCCG<br>AATATCATGGTGGAAAATGGCCGCTTTTCTGGATTCATCGACTGTGGCCGGCTGGGTGTG<br>GCGGACCGCTATCAGGACATAGCGTTGGCTACCCGTGATATTGCTGAAGAGCTTGGCGG<br>CGAATGGGCTGACCGCTTCCTCGTGCTTTACGGTATCGCCGCTCCCGATTCGCAGCGCAT<br>CGCCTTCTATCGCCTTCTTGACGAGTTCTTCGAATTATTAACGCTTACAATTTCCTGATGC<br>GGTATTTTCTCCTTACGCATCTGTGCGGTATTTCACACCGCATACAGGTGGCACTTTTCG<br>GGGAAATGTGCGCGGAACCCCTATTTGTTTATTTTTCTAAATACATTCAAATATGTATCC<br>GCTCATGAGACAATAACCCTGATAAATGCTTCAATAATAGCACGTGAGGAGGGCCACCA<br>TGGCCAAGTTGACCAGTGCCGTTCCGGTGCTCACCGCGCGCGACGTCGCCGGAGCGGTC<br>GAGTTCTGGACCGACCGGCTCGGGTTCTCCCGGGACTTCGTGGAGGACGACTTCGCCGGT<br>GTGGTCCGGGACGACGTGACCCTGTTCATCAGCGCGGTCCAGGACCAGGTGGTGCCGGA<br>CAACACCCTGGCCTGGGTGTGGGTGCGCGGCCTGGACGAGCTGTACGCCGAGTGGTCGG<br>AGGTCGTGTCCACGAACTTCCGGGACGCCTCCGGGCCGGCCATGACCGAGATCGGCGAG<br>CAGCCGTGGGGGCGGGAGTTCGCCCTGCGCGACCCGGCCGGCAACTGCGTGCACTTCGT<br>GGCCGAGGAGCAGGACTGACACGTGCTAAAACTTCATTTTTAATTTAAAAGGATCTAGG<br>TGAAGATCCTTTTTGATAATCTCATGACCAAAATCCCTTAACGTGAGTTTTCGTTCCACTG<br>AGCGTCAGACCCCGTAGAAAAGATCAAAGGATCTTCTTGAGATCCTTTTTTTCTGCGCGT<br>AATCTGCTGCTTGCAAACAAAAAAACCACCGCTACCAGCGGTGGTTTGTTTGCCGGATCA<br>AGAGCTACCAACTCTTTTTCCGAAGGTAACTGGCTTCAGCAGAGCGCAGATACCAAATA<br>CTGTCCTTCTAGTGTAGCCGTAGTTAGGCCACCACTTCAAGAACTCTGTAGCACCGCCTA<br>CATACCTCGCTCTGCTAATCCTGTTACCAGTGGCTGCTGCCAGTGGCGATAAGTCGTGTC<br>TTACCGGGTTGGACTCAAGACGATAGTTACCGGATAAGGCGCAGCGGTCGGGCTGAACG<br>GGGGGTTCGTGCACACAGCCCAGCTTGGAGCGAACGACCTACACCGAACTGAGATACCT<br>ACAGCGTGAGCTATGAGAAAGCGCCACGCTTCCCGAAGGGAGAAAGGCGGACAGGTAT<br>CCGGTAAGCGGCAGGGTCGGAACAGGAGAGCGCACGAGGGAGCTTCCAGGGGGAAACG<br>CCTGGTATCTTTATAGTCCTGTCGGGTTTCGCCACCTCTGACTTGAGCGTCGATTTTTGTG<br>ATGCTCGTCAGGGGGCGGAGCCTATGGAAAAACGCCAGCAACGCGGCCTTTTTACGGT<br>TCCTGGCCTTTTGCTGGCCTTTTGCTCACATGTTCTTTCCTGCGTTATCCCCTGATTCTGTG<br>GATAACCGTATTACCGCCTTTGAGTGAGCTGATACCGCTCGCCGCAGCCGAACGACCGA<br>GCGCAGCGAGTCAGTGAGCGAGGAAGCGGAAG |
| J43-Anti-PD1-<br>scFv-V5-HIS<br>SEQ ID NO: 976 | AtgcaattgGAAGTTCGCCTGTTGGAGAGCGGtGGtGGACTTGTGAAACCCGAGGGAAGCCTT<br>AAACTTTCGTGCGTTGCTAGTGGGTTCACATTTTCAGACTATTTCATGTCCTGGGTCCGTC<br>AAGCCCCGGGAAAAGGACTTGAATGGGTTGCCCATATTTACACCAAGAGCTATAACTAT<br>GCCACATACTATTCTGGAAGCGTTAAAGGTCGTTTTACCATTTCGCGTGACGACAGCCGT<br>TCtATGGTGTATTTGCAGATGAATAACCTTCGTACAGAAGATACGGCTACTTACTACTGTA<br>CTCGCGATGGATCAGGCTATCCCAGTTTAGATTTCTGGGGACAGGGTACTCAGGTTACTG |

TABLE 113-continued

PD1-scFv sequences

| Description | Sequence |
|---|---|
|  | TTTCAAGCGGTGGAGGCGGCTCTGGCGGTGGTGGGAGTGGAGGCGGTGGCAGTTACGAG<br>CTGACGCAGCCaCCCTCGGCAAGTGTAAACGTGGGCGAAACGGTGAAAATTACTTGTTCG<br>GGGGATCAACTGCCCAAATACTTCGCCGATTGGTTTCATCAACGTTCCGATCAGACTATT<br>TTACAAGTGATTTATGATGATAACAAACGTCCGTCAGGAATCCCAGAGCGTATCAGCGG<br>ATCGAGCAGCGGAACAACAGCAACTTTGACCATCCGCGATGTCCGTGCCGAAGACGAGG<br>GGGACTACTATTGTTTCTCTGGATACGTGGACTCAGACAGCAAGCTGTATGTTTTTGGCT<br>CAGGAACACAACTGACCGTACTGGGCAAGGGCGAGCTCAATTCGAAGCTTGAAGGTAAG<br>CCTATCCCTAACCCTCTCCTCGGcCTCGATTCTACGCGTACCGGTCATCATCACCATCACC<br>ATTGA |
| scFvHeavy chain<br>SEQ ID NO: 977 | GAAGTTCGCCTGTTGGAGAGCGGtGGtGGACTTGTGAAACCCGAGGGAAGCCTTAAACTT<br>TCGTGCGTTGCTAGTGGGTTCACATTTTCAGACTATTTCATGTCCTGGGTCCGTCAAGCCC<br>CGGGAAAAGGACTTGAATGGGTTGCCCATATTTACACCAAGAGCTATAACTATGCCACA<br>TACTATTCTGGAAGCGTTAAAGGTCGTTTTACCATTTCGCGTGACGACAGCCGTTCtATGG<br>TGTATTTGCAGATGAATAACCTTCGTACAGAAGATACGGCTACTTACTACTGTACTCGCG<br>ATGGATCAGGCTATCCCAGTTTAGATTTCTGGGGACAGGGTACTCAGGTTACTGTTTCAA<br>GC |
| scFvLight chain<br>SEQ ID NO: 978 | TACGAGCTGACGCAGCCaCCCTCGGCAAGTGTAAACGTGGGCGAAACGGTGAAAATTAC<br>TTGTTCGGGGGATCAACTGCCCAAATACTTCGCCGATTGGTTTCATCAACGTTCCGATCA<br>GACTATTTTACAAGTGATTTATGATGATAACAAACGTCCGTCAGGAATCCCAGAGCGTAT<br>CAGCGGATCGAGCAGCGGAACAACAGCAACTTTGACCATCCGCGATGTCCGTGCCGAAG<br>ACGAGGGGGACTACTATTGTTTCTCTGGATACGTGGACTCAGACAGCAAGCTGTATGTTT<br>TTGGCTCAGGAACACAACTGACCGTACTGGGC |
| scFvLinker<br>SEQ ID NO: 979 | GGTGGAGGCGGCTCTGGCGGTGGTGGGAGTGGAGGCGGTGGCAGT |
| J43-Anti-PD1-scFV<br>polypeptide sequence<br>SEQ ID NO: 980 | MQLEVRLLESGGGLVKPEGSLKLSCVASGFTFSDYFMSWVRQAPGKGLEWVAHIYTKSYN<br>YATYYSGSVKGRFTISRDDSRSMVYLQMNNLRTEDTATYYCTRDGSGYPSLDFWGQGTQV<br>TVSSGGGGSGGGGSGGGGSYELTQPPSASVNVGETVKITCSGDQLPKYFADWFHQRSDQT<br>ILQVIYDDNKRPSGIPERISGSSSGTTATLTIRDVRAEDEGDYYCFSGYVDSDSKLYVFG<br>SGTQLTVLGKGELNSKLEGKPIPNPLLGLDSTRTGHHHHHH |

In some embodiments, the PD1-scFv is at least about 80%, at least about 85%, at least about 90%, at least about 95%, or at least about 99% homologous to the sequence of SEQ ID NO: 975, SEQ ID NO: 976, SEQ ID NO: 977, SEQ ID NO: 978, SEQ ID NO: 979, and/or SEQ ID NO: 980.

E. coli comprising either tet-inducible J43-Anti-PD1-scFv-V5 or wild type controls were grown overnight in LB medium. Cultures were diluted 1:40 in LB and grown shaking (250 rpm) to an optical density of 0.8 at which time anhydrous tetracycline (ATC) was added to cultures at a concentration of 100 ng/mL to induce expression of J43-Anti-PD1-scFv-V5. Same amount of tetracycline was added to wild type control cultures. After 4 hrs of induction, bacteria were pelleted, washed in PBS, and harvested, resuspended in 2 mL sonication buffer (PBS), and lysed by sonication on ice. Insoluble debris was spun down twice for 15 min at 12,000 rpm at 4° C.

Protein concentration was determined by BCA protein assay, and isolated extracts from wild type and strains comprising the Ptet-J43-Anti-PD1-scFV-V5 were analyzed by Western blot. Proteins were transferred onto PVDF membranes and J43-Anti-PD1-scFv was detected with an HRP-conjugated anti-V5 antibody (Biolegend). Results are shown in FIG. 30. A single band was detected at 27 kDa in lane 2 (extract from J43-Anti-PD1-scFv-V5 strain). No bands were detected in lane 1 (wild type extract).

To determine whether the single-chain antibody purified from E. coli DH5a functionally binds to the target protein, PD1, an ELISA assay was performed. Plates were absorbed overnight at 4° C. with 100 µL of 2 µg/mL per well of PD1 (Rndsystems). Wells were blocked with 2% BSA in PBS/0.1% Tween-20 for 2 hours at room temperature. After three washes, wells were incubated with bacterial extracts (J43-scFv-V5 or wild type-neg-ctrl) for 1 hour at room temperature. Wells were washed 4 times with PBST (PBS/0.1% Tween-20) and incubated with a HRP-conjugated anti-V5 antibody (Biolegend) in blocking solution for 40 min. Following incubation, wells were washed 4 times with PBST and then stained using a 3,3',5,5'-tetramethylbenzidine (TMB). Signal intensities were measured using an ELISA reader at 450 nm. Results are shown in Table 114 and indicate that the antibody expressed by the genetically engineered bacteria can bind to PD1 specifically.

TABLE 114

ELISA Binding Assay

| 1' antibody | PBS coating | mPD1 coating | IgG coating | 2' antibody |
|---|---|---|---|---|
| Wild type-neg-ctrl | 0.11 | 0.13 | 0.12 | α-V5-HRP |
| J43-scFv-V5 | 0.11 | 1.41 | 0.13 | α-V5-HRP |
| Wild type-neg-ctrl (1/2) | 0.10 | 0.09 | 0.10 | α-V5-HRP |
| J43-scFv-V5 (1/2) | 0.10 | 0.90 | 0.11 | α-V5-HRP |

Next, recombinant J43-Anti-scFv-V5 was expression using pET22b vector harvesting a C-terminal poly-histidine tag and purified using immobilized metal ion affinity chromatography. Protein concentration was determined by absorption at 280 nm and purity was confirmed by Coomassie gel (data not shown).

To determine whether anti-PD1-scFv expressed in E. coli binds to surface PD1 on mouse EL4 cells, flow cytometric analysis was performed using EL4 cells. EL4 are a mouse lymphoma cell line which expresses PD1 on its cell surface.

EL4 cells were grown in Dulbecco's Modified Eagle's Medium (DMEM) with 10% FBS. Cells were spun down, supernatant was aspirated, pellet was resuspended in 1 ml D-PBS, transferred into chilled assay tubes (1×106 cells), and washed 2-3 times in D-PBS with 0.5% BSA. Cells were resuspended in PBS with 0.5% BSA, to which the purified scFv-V5 and anti-V5-FITC antibody were added and incubated for 1 hour at room temperature. Negative control left out scFv-V5. Cells were resuspended in 0.5 ml PBS and analyzed on a flow cytometer. Results are shown in FIG. 31. A population shift is observed only when the purified anti-PD1-scFv-V5 and anti-V5-FITC were both present (two different batches were shown), relative to samples with EL4 alone and EL4 plus secondary antibody only.

Example 55. Secretion of anti-mPD1-scFv

To generate genetically engineered bacteria which are capable of secreting anti-mPD1-scFv, constructs were generated according to methods described herein as shown in Table 115. Sequences are shown in Table 116.

TABLE 115

Strains for secretion of anti-mPD1-scFv

| Strain Number | Genotype | Construct |
|---|---|---|
| SYN2790 | Nissle delta nlpI::CmR | pUC-ptet-OmpF-FLAG-J43scFv-V5-HIS |
| SYN2767 | Nissle delta tolA::CmR | pUC-ptet-OmpF-FLAG-J43scFv-V5-HIS |
| SYN2768 | Nissle delta PAL::CmR | pUC-ptet-OmpF-FLAG-J43scFv-V5-HIS |
| SYN2769 | Nissle delta lpp::CmR | pUC-ptet-OmpF-FLAG-J43scFv-V5-HIS |
| SYN2770 | Nissle delta nlpI::CmR | pUC-ptet-PhoA-FLAG-J43scFv-V5-HIS |
| SYN2771 | Nissle delta tolA::CmR | pUC-ptet-PhoA-FLAG-J43scFv-V5-HIS |
| SYN2772 | Nissle delta PAL::CmR | pUC-ptet-PhoA-FLAG-J43scFv-V5-HIS |
| SYN2773 | Nissle delta lpp::CmR | pUC-ptet-PhoA-FLAG-J43scFv-V5-HIS |
| SYN2774 | Nissle delta nlpI::CmR | pUC-ptet-PelB-FLAG-J43scFv-V5-HIS |
| SYN2775 | Nissle delta tolA::CmR | pUC-ptet-PelB-FLAG-J43scFv-V5-HIS |
| SYN2776 | Nissle delta PAL::CmR | pUC-ptet-PelB-FLAG-J43scFv-V5-HIS |
| SYN2777 | Nissle delta lpp::CmR | pUC-ptet-PelB-FLAG-J43scFv-V5-HIS |

TABLE 116 scFv Secretion Construct Sequences

| Description | Sequence |
|---|---|
| Ptet-phoA-FLAG-J43-scFv-V5-HIS SEQ ID NO: 981 | ttaagacccactttcacatttaagttgtttttctaatccgcagatgatcaattcaaggccgaataagaaggctg gctctgcaccttggtgatcaaataattcgatagcttgtcgtaataatggcggcatactatcagtagtaggtgtt tcccttcttcttagcgacttgatgctcttgatcttccaatacgcaacctaaagtaaaatgccccacagcgct gagtgcatataatgcattctctagtgaaaaaccttgttggcataaaaaggctaattgattttcgagagtttcat actgttttctgtaggccgtgtacctaaatgtacttttgctccatcgcgatgacttagtaaagcacatctaaaa cttttagcgttattacgtaaaaaatcttgccagctttccccttctaaagggcaaaagtgagtatggtgcctatc taacatctcaatggctaaggcgtcgagcaaagcccgcttattttttacatgccaatacaatgtaggctgctcta cacctagcttctgggcgagtttacgggttgttaaaccttcgattccgacctcattaagcagctctaatgcgctg ttaatcacttttacttttatctaatctagacataattaattcctaattttttgttgacactctatcattgatagag ttattttaccactccctatcagtgatagagaaaagtgaaaggaggtaaattATGACTAGTaaacaatcgaccat cgcattggcgctgcttcctctattgttcacaccggtgacaaaggcagtcGACTATAAGGATGACGACGACAAGc aattgggcggtggcatgGAAGTTCGCCTGTTGGAGAGCGGtGGaGGACTTGTGAAgCCCGAGGGAAGCCTTAAA CTTTCGTGCGTTGCTAGTGGGTTCACATTTTCAGACTATTTCATGTCCTGGGTCCGTCAAGCCCCGGGAAAAGG ACTTGAATGGGTTGCCCATATTTACACCAAGAGCTATAACTATGCCACATACTATTCTGGAAGCGTTAAAGGTC GTTTTACCATTTCGCGTGACGACAGCCGTTCtATGGTGTATTTGCAGATGAATAACCTTC GTACAGAAGATACGGCTACTTACTACTGTACTCGCGATGGATCAGGCTATCCCAGTTTAGATTT CTGGGGACAGGGTACTCAGGTTACTGTTTCAAGCGGTGGAGGCGGCTCTGGCGGTGGTGGGAG TGGAGGCGGTGGCAGTTACGAGCTGACGCAGCCGCCCTCGGCAAGTGTAAACGTGGGCGAAAC GGTGAAAATTACTTGTTCGGGGGATCAACTGCCCAAATACTTCGCCGATTGGTTTCATCAACGT TCCGATCAGACTATTTTACAAGTGATTTATGATGATAACAAACGTCCGTCAGGAATCCCAGAGC GTATCAGCGGATCGAGCAGCGGAACAACAGCAACTTTGACCATCCGCGATGTCCGTGCCGAAG ACGAGGGGGACTACTATTGTTTCTCTGGATACGTGGACTCAGACAGCAAGCTGTATGTTTTGG CTCAGGAACACAACTGACCGTACTGGGCAAGGGCGAGCTCAATTCGAAGCTTGAAGGTAAGCC TATCCCTAACCCTCTCCTCGGaCTCGATTCTACGggatccGGTCATCATCACCATCACCATTGA |
| phoA-FLAG-J43-scFv-V5-HIS SEQ ID NO: 982 | KQSTIALALLPLLFTPVTKAVDYKDDDDKQLGGGMEVRLLESGGGLVKPEGSLKLSCVAS GFTFSDYFMSWVRQAPGKGLEWVAHIYTKSYNYATYYSGSVKGRFTISRDDSRSMVYLQM NNLRTEDTATYYCTRDGSGYPSLDFWGQGTQVTVSSGGGGSGGGGSGGGGSYELTQPPSA SVNVGETVKITCSGDQLPKYFADWFHQRSDQTILQVIYDDNKRPSGIPERISGSSSGTTA TLTIRDVRAEDEGDYYCFSGYVDSDSKLYVFGSGTQLTVLGKGELNSKLEGKPIPNPLLG LDSTGSGHHHHHH |
| Ptet-ompF-FLAG-J43-scFv-V5-HIS SEQ ID NO: 983 | ttaagacccactttcacatttaagttgtttttctaatccgcagatgatcaattcaaggccgaataagaaggctg gctctgcaccttggtgatcaaataattcgatagcttgtcgtaataatggcggcatactatcagtagtaggtgtt tcccttcttcttagcgacttgatgctcttgatcttccaatacgcaacctaaagtaaaatgccccacagcgct gagtgcatataatgcattctctagtgaaaaaccttgttggcataaaaaggctaattgattttcgagagtttcat actgttttctgtaggccgtgtacctaaatgtacttttgctccatcgcgatgacttagtaaagcacatctaaaa cttttagcgttattacgtaaaaaatcttgccagctttccccttctaaagggcaaaagtgagtatggtgcctatc taacatctcaatggctaaggcgtcgagcaaagcccgcttattttttacatgccaatacaatgtaggctgctcta cacctagcttctgggcgagtttacgggttgttaaaccttcgattccgacctcattaagcagctctaatgcgctg ttaatcacttttacttttatctaatctagacataattaattcctaattttttgttgacactctatcattgatagag |

TABLE 116-continued scFv Secretion Construct Sequences

| Description | Sequence |
|---|---|
| | ttattttaccactccctatcagtgatagagaaaagtgaaaggaggtaaattATGACTAGTATGATGAAGCGTAA<br>CATCTTAGCCGTTATTGTCCCCGCATTGCTTGTGGCCGGGACGGCTAACGCAgtcGACTATAAGGATGACGACG<br>ACAAGcaattgggcggtggcatgGAAGTTCGCCTGTTGGAGAGCGGtGGaGGaCTTGTGAAgCCC<br>GAGGGAAGCCTTAAACTTTCGTGCGTTGCTAGTGGGTTCACATTTTCAGACTATTTCATGTCCTG<br>GGTCCGTCAAGCCCCGGGAAAAGGACTTGAATGGGTTGCCCATATTTACACCAAGAGCTATAA<br>CTATGCCACATACTATTCTGGAAGCGTTAAAGGTCGTTTTACCATTTCGCGTGACGACAGCCGT<br>TCtATGGTGTATTTGCAGATGAATAACCTTCGTACAGAAGATACGGCTACTTACTACTGTACTCG<br>CGATGGATCAGGCTATCCCAGTTTAGATTTCTGGGGACAGGGTACTCAGGTTACTGTTTCAAGC<br>GGTGGAGGCGGCTCTGGCGGTGGTGGGAGTGGAGGCGGTGGCAGTTACGAGCTGACGCAGCCG<br>CCCTCGGCAAGTGTAAACGTGGGCGAAACGGTGAAAATTACTTGTTCGGGGGATCAACTGCCC<br>AAATACTTCGCCGATTGGTTTCATCAACGTTCCGATCAGACTATTTACAAGTGATTTATGATGA<br>TAACAAACGTCCGTCAGGAATCCCAGAGCGTATCAGCGGATCGAGCAGCGGAACAACAGCAAC<br>TTTGACCATCCGCGATGTCCGTGCCGAAGACGAGGGGGACTACTATTGTTTCTCTGGATACGTG<br>GACTCAGACAGCAAGCTGTATGTTTTTGGCTCAGGAACACAACTGACCGTACTGGGCAAGGGC<br>GAGCTCAATTCGAAGCTTGAAGGTAAGCCTATCCCTAACCCTCTCCTCGGaCTCGATTCTACGgg<br>atccGGTCATCATCACCATCACCATTGA |
| ompF-FLAG-<br>J43-scFv-<br>V5-HIS<br>SEQ ID NO:<br>984 | MMKRNILAVIVPALLVAGTANAVDYKDDDDKQLGGGMEVRLLESGGGLVKPEGSLKLSCV<br>ASGFTFSDYFMSWVRQAPGKGLEWVAHIYTKSYNYATYYSGSVKGRFTISRDDSRSMVYL<br>QMNNLRTEDTATYYCTRDGSGYPSLDFWGQGTQVTVSSGGGGSGGGGSGGGGSYELTQPP<br>SASVNVGETVKITCSGDQLPKYFADWFHQRSDQTILQVIYDDNKRPSGIPERISGSSSGT<br>TATLTIRDVRAEDEGDYYCFSGYVDSDSKLYVFGSGTQLTVLGKGELNSKLEGKPIPNPL<br>LGLDSTGSGHHHHHH |
| Ptet-PelB-<br>FLAG-J43-<br>scFv-V5-HIS<br>SEQ ID NO:<br>985 | ttaagacccactttcacatttaagttgttttctaatccgcagatgatcaattcaaggccgaataagaaggctg<br>gctctgcaccttggtgatcaaataattcgatagcttgtcgtaataatggcggcatactatcagtagtaggtgtt<br>tccctttcttcttttagcgacttgatgctcttgatcttccaatacgcaacctaaagtaaaatgccccacagcgct<br>gagtgcatataatgcattctctagtgaaaaaccttgttggcataaaaaggctaattgattttcgagagtttcat<br>actgttttctgtaggccgtgtacctaaatgtacttttgctccatcgcgatgacttagtaaagcacatctaaaa<br>cttttagcgttattacgtaaaaaatcttgccagctttccccttctaaagggcaaaagtgagtatggtgcctatc<br>taacatctcaatggctaaggcgtcgagcaaagcccgcttattttttacatgccaatacaatgtaggctgctcta<br>cacctagcttctgggcgagtttacgggttgttaaaccttcgattccgacctcattaagcagctctaatgcgctg<br>ttaatcactttacttttatctaatctagacatcattaattcctaattttttgttgacactctatcattgatagag<br>ttattttaccactccctatcagtgatagagaaaagtgaaaggaggtaaattATGACTAGTAAATATCTTCTTCC<br>AACGGCTGCTGCTGGTTTATTGCTTCTTGCCGCCCAGCCTGCGATGGCTGtcGACTATAAGGATGACGA<br>CGACAAGcaattgggcggtggcatgGAAGTTCGCCTGTTGGAGAGCGGtGGaGGaCTTGTGAAgCCCGAGG<br>GAAGCCTTAAACTTTCGTGCGTTGCTAGTGGGTTCACATTTTCAGACTATTTCATGTCCTGGGTC<br>CGTCAAGCCCCGGGAAAAGGACTTGAATGGGTTGCCCATATTTACACCAAGAGCTATAACTAT<br>GCCACATACTATTCTGGAAGCGTTAAAGGTCGTTTTACCATTTCGCGTGACGACAGCCGTTCtAT<br>GGTGTATTTGCAGATGAATAACCTTCGTACAGAAGATACGGCTACTTACTACTGTACTCGCGAT<br>GGATCAGGCTATCCCAGTTTAGATTTCTGGGGACAGGGTACTCAGGTTACTGTTTCAAGCGGTG<br>GAGGCGGCTCTGGCGGTGGTGGGAGTGGAGGCGGTGGCAGTTACGAGCTGACGCAGCCGCCT<br>CGGCAAGTGTAAACGTGGGCGAAACGGTGAAAATTACTTGTTCGGGGGATCAACTGCCCAAAT<br>ACTTCGCCGATTGGTTTCATCAACGTTCCGATCAGACTATTTTACAAGTGATTTATGATGATAAC<br>AAACGTCCGTCAGGAATCCCAGAGCGTATCAGCGGATCGAGCAGCGGAACAACAGCAACTTTG<br>ACCATCCGCGATGTCCGTGCCGAAGACGAGGGGGACTACTATTGTTTCTCTGGATACGTGGACT<br>CAGACAGCAAGCTGTATGTTTTTGGCTCAGGAACACAACTGACCGTACTGGGCAAGGGCGAGC<br>TCAATTCGAAGCTTGAAGGTAAGCCTATCCCTAACCCTCTCCTCGGaCTCGATTCTACGggatccGG<br>TCATCATCACCATCACCAT |
| PelB-FLAG-<br>J43-scFv-<br>V5-HIS<br>SEQ ID NO:<br>986 | KYLLPTAAAGLLLLAAQPAMAVDYKDDDDKQLGGGMEVRLLESGGGLVKPEGSLKLSCVA<br>SGFTFSDYFMSWVRQAPGKGLEWVAHIYTKSYNYATYYSGSVKGRFTISRDDSRSMVYLQ<br>MNNLRTEDTATYYCTRDGSGYPSLDFWGQGTQVTVSSGGGGSGGGGSGGGGSYELTQPPS<br>ASVNVGETVKITCSGDQLPKYFADWFHQRSDQTILQVIYDDNKRPSGIPERISGSSSGTT<br>ATLTIRDVRAEDEGDYYCFSGYVDSDSKLYVFGSGTQLTVLGKGELNSKLEGKPIPNPLL<br>GLDSTGSGHHHHHH |

In some embodiments, the scFv Secretion Construct is at least about 80%, at least about 85%, at least about 90%, at least about 95%, or at least about 99% homologous to the sequence of SEQ ID NO: 981, SEQ ID NO: 982, SEQ ID NO: 983, SEQ ID NO: 984, SEQ ID NO: 985, and/or SEQ ID NO: 986.

E. coli Nissle comprising plasmid based construct comprising tet-inducible J43-Anti-scFv-V5 with PhoA, OmpF or PelB secretion tags (see Table 3) or wild type control were grown overnight in LB medium. Cultures were diluted 1:100 in LB and grown shaking (200 rpm) to an optical density of 0.8 at which time cultures were cooled down to room temperature and anhydrous tetracycline (ATC) was added to cultures at a concentration of 100 ng/mL to induce expression of PhoA-, OmpF- or PelB-J43-Anti-scFv-V5. No tetracycline was added to wild type Nissle cultures. After 18 hrs of induction at room temperature, bacteria were pelleted, and the supernatant was collected and placed on ice.

Protein concentration in the medium and the cell lysates was determined by BCA protein assay, and isolated extracts and media from wild type and strains comprising the Ptet-J43-anti-scFv-V5 were analyzed by Western blot. Proteins were transferred onto PVDF membranes and J43-anti-scFv detected with an HRP-conjugated anti-V5 antibody (Biolegend). Results are shown in FIG. 32. A single band was detected around 34 kDa in lane 1-6 corresponding to extracts from SYN2767, SYN2769, SYN2771, SYN2773, SYN2775 and SYN2777 respectively.

To determine whether the secreted J43-anti-scFv in E coli Nissle binds to PD1 on mouse cells, flow cytometric analysis was performed using EL4 cells. EL4 are a mouse lymphoma cell line which expresses PD1 on its cell surface.

EL4 cells were grown in Dulbecco's Modified Eagle's Medium (DMEM) with 10% FBS and 1% Penicillin-Streptomycin Cells were spun down, supernatant was aspirated, pellet was resuspended in 1 ml D-PBS, transferred into chilled assay tubes (1×10^6 cells), and washed 3 times in D-PBS. Cells were resuspended in D-PBS with 0.5% BSA, to which the purified scFv-V5 and anti-V5-FITC antibody were added and incubated for 1 hour at room temperature. Negative control left out secreted J43-scFv-V5. Cells were then resuspended in 0.5 ml PBS and analyzed on a flow cytometer. Results are shown in FIG. 33. A population shift is observed only when the secreted anti-PD1-scFv-V5 (1' antibody) and anti-V5-FITC (2' antibody) were both present, relative to samples with EL4 alone and EL4 plus secondary antibody only. A similar study was conducted with different amounts of the secreted scFv (0, 2, 5, and 15 µL), and a dose-dependent staining of the EL4 cells was observed FIG. 34.

Next, a competition assay was conducted to determine whether PDL1 could inhibit the binding of the anti-PD1-scFv secreted by the genetically engineered bacteria from binding to murine PD1. EL4 cells were grown and flow cytometry protocol was conducted essentially as described above except that PDL1 was added at various concentrations (0, 5, 10, and 30 µg/mL) during the incubation of the secreted anti-PD1-scFv-V5. Rat-IgG was used as a negative control of secreted scFv. Results are shown in FIG. 35. PDL1 competed in a dose dependent manner against the binding of secreted anti-mPD1-scFv to mPD1 on the surface of EL4 cells. Negative control of Rat-IgG protein did not show similar dose dependent binding competition.

Example 56. Display of Anti-mPD1-scFv on *E coli* Nissle Cell Surface

To generate genetically engineered bacteria which are capable of displaying anti-mPD1-scFv on the Nissle cell surface, constructs were generated according to methods described herein as shown in Table 117. Sequences are shown in Table 118.

TABLE 117

Strains for display of anti-mPD1-scFv

| Strain Number | Host Strain Genotype | Construct |
| --- | --- | --- |
| SYN2797 | wt Nissle | p15A-Kan-ptet-Invasin-FLAG-J43scFv-V5-HIS |
| SYN2798 | wt Nissle | p15A-Kan-ptet-LppOmpA-FLAG-J43scFv-V5-HIS |
| SYN2799 | wt Nissle | p15A-Kan-ptet-IntiminN-FLAG-J43scFv-V5-HIS |

TABLE 118 scFv Display Construct Sequences

| Description | Sequence |
| --- | --- |
| p15A-Kan-ptet-Invasin-FLAG-J43scFv-V5-HIS SEQ ID NO: 987 | tagcggagtgtatactggcttactatgttggcactgatgagggtgtcagtgaagtgcttcatgtggcaggagaa aaaaggctgcaccggtgcgtcagcagaatatgtgatacaggatatattccgcttcctcgctcactgactcgcta cgctcggtcgttcgactgcggcgagcggaaatggcttacgaacggggcggagatttcctggaagatgccaggaa gatacttaacagggaagtgagagggccgcggcaaagccgttttccataggctccgcccccctgacaagcatca cgaaatctgacgctcaaatcagtggtggcgaaacccgacaggactataaagataccaggcgtttccctggcgg ctccctcgtgcgctctcctgttcctgcctttcggtttaccggtgtcattccgctgttatggccgcgtttgtctc attccacgcctgacactcagttccgggtaggcagttcgctccaagctggactgtatgcacgaacccccgttca gtccgaccgctgcgccttatccggtaactatcgtcttgagtccaacccggaaagacatgcaaaagcaccactgg cagcagccactggtaattgatttagaggagttagtcttgaagtcatgcgccggttaaggctaaactgaaaggac aagttttggtgactgcgctcctccaagccagttacctcggttcaaagagttggtagctcagagaaccttcgaaa aaccgcctgcaaggcggttttttcgttttcagagcaagagattacgcgcagaccaaaacgatctcaagaagat catcttattaagggtctgacgctcagtggaacggtgcaccctgcagggctagctgataaagcgttcgcgctgc attcggcagtttaagacccacttcacatttaagttgttttctaatccgcatatgatcaattcaaggccgaat aagaaggctggctctgcaccttggtgatcaaataattcgatagcttgtcgtaataatggcggcatactatcagt agtaggtgtttcccttcttctttagcgacttgatgctcttgatcttccaatacgcaacctaaagtaaaatgcc ccacagcgctgagtgcatataatgcattctctagtgaaaaaccttgttggcataaaaaggctaattgatttcg agagtttcatactgtttttctgtaggccgtgtacctaaatgtacttttgctccatcgcgatgacttagtaaagc acatctaaaactttagcgttattacgtaaaaaacttctcgttaaaaggacttctcccttctaaaggggcaaaagtgagtat ggtgcctatctaacatctcaatggctaaggcgtcgagcaaagcccgcttattttttacatgccaatacaatgta ggctgctctacacctagcttctgggcgagtttacgggtgttaaaccttcgattccgacctcattaagcagctc taatgcgctgttaatcacttttacttttatctaatctagacatcattaattcctaatttttgttgacactctatc attgatagagttattttaccactccctatcagtgatagagaaaagtgaaaggaggtaaattATGACTAGTATGG TTTTCCAACCCATCAGCGAATTTTTGCTGATTCGTAACGCTGGGATGTCCATGTATTTTAACAAGATCAT TTCTTTTAACATCATTTCACGTATCGTTATTTGCATTTTTCTTATCTGTGGTATGTTCATGGCC GGTGCATCTGAAAAGTATGATGCAAACGCACCCCAACAGGTGCAGCCATACTCGGTTTCATC ATCAGCGTTCGAGAATCTGCACCCCAATAACGAGATGGAGTCGAGTATCAACCCTTTTAGTG CTTCGGACACCGAGCGTAATGCAGCTATCATCGATCGTGCTAACAAGGAACAAGAAACGGA AGCAGTCAACAAAATGATCTCCACTGGCGCTCGTTTAGCTGCCAGCGGTCGCGCGTCCGATG TGGCGCACAGTATGGTAGGGGATGCGGTCAACCAGGAGATTAAACAATGGCTGAATCGCTT CGGCACTGCTCAAGTGAATTTAAATTTTGACAAGAACTTCTCGTTAAAGGAGTCTTCGCTTGA CTGGTTGGCCCCATGGTACGATTCGGCGTCATTCCTTTTCTTTTCTCAGTTGGGCATCCGTAA CAAGGACAGTCGTAATACACTTAACCTTGGTGTTGGCATTCGCACATTAGAAAATGGTTGGT TGTATGGCCTGAACACCTTTTACGACAATGACTTAACGGGACACAATCACCGTATCGGCTG GGCGCCGAGGCGTGGACTGACTACTTGCAGTTAGCCGCGAATGGGTACTTCCGTCTTAATGG TTGGCACTCTTCCCGTGACTTCAGCGACTACAAAGAACGCCCTGCTACCGGGGGAGATTTGC |

TABLE 118-continued scFv Display Construct Sequences

| Description | Sequence |
|---|---|
| | GTGCGAATGCGTACCTGCCCGCTCTTCCGCAACTTGGCGGGAAGTTAATGTATGAGCAGTAT<br>ACTGGGGAACGCGTGGCTCTGTTCGGAAAGGACAACCTGCAGCGCAACCCATACGCTGTCAC<br>TGCGGGTATCAACTATACGCCAGTTCCGTTGCTGACGGTCGGCGTGGATCAACGTATGGGGA<br>AGTCGAGTAAACATGAAACGCAATGGAATTTACAAATGAACTATCGCTTAGGGGAGAGTTTC<br>CAAAGTCAGCTTAGCCCTTCGGCGGTCGCAGGGACTCGTTTGCTTGCTGAGTCCCGCTACAA<br>CCTGGTTGATCGCAATAACAATATCGTACTGGAATACCAGAAACAACAAGTGGTTAAGCTGA<br>CGTTGAGCCCTGCGACCATCAGTGGATTGCCCGGACAAGTTTACCAGGTAAATGCCCAGGTC<br>CAGGGGGCCTCTGCGGTTCGCGAAATTGTCTGGTCAGACGCAGAATTAATCGCTGCAGGAGG<br>CACCTTAACGCCACTTTCCACTACACAATTCAATTTAGTCCTTCCCCCATACAAACGTACCGC<br>CCAGGTATCGCGCGTAACTGATGACTTAACTGCTAATTTTTATTCACTGTCGGCGTTAGCAGT<br>TGACCATCAAGGCAACCGTAGTAATTCCTTCACATTATCTGTAACGGTGCAGCAGCCGCAAC<br>TGACGCTTACCGCAGCGGTCATTGGTGATGGGGCCCCAGCTAATGGGAAAACCGCAATCACT<br>GTCGAgTTCACAGTTGCAGATTTTGAAGGCAAGCCGCTGGCGGGTCAGGAGGTTGTGATTAC<br>GACTAATAACGGTGCTCTTCCTAATAAGATTACTGAAAAGACTGACGCTAACGGCGTTGCCC<br>GCATTGCCCTTACGAACACAACCGATGGGGTCACGGTAGTTACCGCAGAGGTCGAGGGGCA<br>ACGCCAATCCGTTGACACGCACTTCGTTAAGGGTACTATCGCGGCCGATAAAAGCACGCTGG<br>CCGCGGTcGACTATAAGGATGACGACGACAAGcaattgGAAGTTCGCCTGTTGGAGAGCGGtGGt<br>GGACTTGTGAAACCCGAGGGAAGCCTTAAACTTTCGTGCGTTGCTAGTGGGTTCACATTTTC<br>AGACTATTTCATGTCCTGGGTCCGTCAAGCCCCGGGAAAAGGACTTGAATGGGTTGCCCATA<br>TTTACACCAAGAGCTATAACTATGCCACATACTATTCTGGAAGCGTTAAAGGTCGTTTTACCA<br>TTTCGCGTGACGACAGCCGTTCtATGGTGTATTTGCAGATGAATAACCTTCGTACAGAAGATA<br>CGGCTACTTACTACTGTACTCGCGATGGATCAGGCTATCCCAGTTTAGATTTCTGGGGACAG<br>GGTACTCAGGTTACTGTTTCAAGCGGTGGAGGCGGCTCTGGCGGTGGTGGGAGTGGAGGCG<br>GTGGCAGTTACGAGCTGACGCAGCCaCCCTCGGCAAGTGTAAACGTGGGCGAAACGGTGAA<br>AATTACTTGTTCGGGGGATCAACTGCCCAAATACTTCGCCGATTGGTTTCATCAACGTTCCGA<br>TCAGACTATTTTACAAGTGATTTATGATGATAACAAACGTCCGTCAGGAATCCCAGAGCGTA<br>TCAGCGGATCGAGCAGCGGAACAACAGCAACTTTGACCATCCGCGATGTCCGTGCCGAAGA<br>CGAGGGGGACTACTATTGTTTCTCTGGATACGTGGACTCAGACAGCAAGCTGTATGTTTTG<br>GCTCAGGAACACAACTGACCGTACTGGGCAAGGGCGAGCTCAATTCGAAGCTTGAAGGTAA<br>GCCTATCCCTAACCCTCTCCTCGGcCTCGATTCTACGCGTACCGGTCATCATCACCATCACCA<br>TTGAGCATGCTAATCAGCCGTGGAATTCGCAACGTAAAAAAACCCGCCCCGGCGGGTTTTTT<br>TATACCGGTCTCaGGAGgAACGATTGGTAAACCCGGTGaacgcatgagAAAGCCCCCGGAAGATCA<br>CCTTCCGGGGGCTTTtttattgcgcGGACCAAAACGAAAAAAGACGCTCGAAAGCGTCTCTTTTCTG<br>GAATTTGGTACCGAGGcgtaatgctctgccagtgttagaacaattaaccaattctgattagaaaaactcatcg<br>agcatcaaatgaaactgcaatttattcatatcaggattatcaataccatatttttgaaaaagccgtttctgtaa<br>tgaaggagaaaactcaccgaggcagttccataggatggcaagatcctggtatcggtctgcgattccgactcgtc<br>caacatcaatacaacctattaatttcccctcgtcaaaaataaggttatcaagtgagaaatcaccatgagtgacg<br>actgaatccggtgagaatggcaaaagcttatgcatttctttccagacttgttcaacaggccagccattacgctc<br>gtcatcaaaatcactcgcatcaaccaaaccgttattcattcgtgattgcgcctgagcgagacgaaatacgcgat<br>cgctgttaaaaggacaattacaaacaggaatcgaatgcaaccggcgcaggaacactgccagcgcatcaacaata<br>ttttcacctgaatcaggatattcttctaatacctggaatgctgttttcccggggatcgcagtggtgagtaacca<br>tgcatcatcaggagtacggataaaatgcttgatggtcggaagaggcataaattccgtcagccagtttagtctga<br>ccatctcatctgtaacatcattggcaacgctacctttgccatgtttcagaaacaactctggcgcatcgggcttc<br>ccatacaatcgatagattgtcgcacctgattgcccgacattatcgcgagcccatttatacccatataaatcagc<br>atccatgttggaatttaatcgcggcctcgagcaagacgtttcccgttgaatatggctcataacaccccttgtat<br>tactgtttatgtaagcagacagttttattgttcatgatgatatattttttatcttgtgcaatgtaacatcagaga<br>ttttgagacacaacgtggctttgttgaataaatcgaacttttgctgagttgaaggatcagatcacgcatcttcc<br>cgacaacgcagaccgttccgtggcaaagcaaaagttcaaaatcaccaactggtccacctacaacaaagctctca<br>tcaaccgtggctccctcactttctggctggatgatgggcgattcaggcctggtatgagtcagcaacaccttct<br>tcacgaggcagacctcagcgc |
| p15A-Kan-ptet-<br>LppOmpA-FLAG-<br>J43scFv-V5-HIS<br>SEQ ID NO: 988 | tagcggagtgtatactggcttactatgttggcactgatgagggtgtcagtgaa<br>gtgcttcatgtggcaggagaaaaaaggctgcaccggtgcgtcagcagaatatgtgatacaggatatattccgct<br>tcctcgctcactgactcgctacgctcggtcgttcgactgcggcgagcggaaatggcttacgaacggggcggaga<br>tttcctggaagatgccaggaagatacttaacaggaagtgagagggccgcggcgcaaagccgttttttccataggct<br>ccgcccccctgacaagcatcacgaaatctgacgctcaaatcagtggtggcgaaacccgacaggactataaagat<br>accaggcgtttccctggcggctccctcgtgcgctctcctgttcctgcctttcggtttaccggtgtcattccgc<br>tgttatgccgcgtttgtctcattccacgcctgacactcagttccgggtaggcagttcgctccaagctggactg<br>tatgcacgaacccccgttcgaccgccgctgcgccttatccggtaactatcgtcttgagtccaacccggaaa<br>gacatgcaaaagcaccactggcagcagccactggtaattgattagaggagttagtcttgaagtcatgcgccgg<br>ttaaggctaaactgaaaggacaagtttggtgactgcgctcctccaagccagttacctcggttcaaagagttgg<br>tagctcagagaaccttcgaaaaaccgccctgcaaggcggttttttcgttttcagagcaagagattacgcgcaga<br>ccaaaacgatctcaagaagatcatcttattaagggggtcagtggaacggtgcaccctgcagggctag<br>ctgataaagcgttcgcgctgcattcggcagtttaagacccactttcacattttaagttgttttttctaatccgcat<br>atgatcaattcaaggccgaataagaaggctggctctgcaccttggtgatcaaataattcgatagcttgtcgtaa<br>taatggcggcatactatcagtagtaggtgtttcccttttcttcttagcgacttgatgctcttgatcttccaata<br>cgcaacctaaagtaaaatgccccacagcgctgagtgcataaccatcgattctctagtgaaaaaccttgttggcat<br>aaaaaggctaattgatttttcgagagtttcatactgtttttctgtaggccgtgtacctaaatgtacttttgctcc<br>atcgcgatgacttagtaaagcacatctaaaactttagcgttattacgtaaaaaatcttgccagctttcccctt<br>ctaaagggcaaaagtgagtatggtgcctatctaacatctcaatggctaaggcgtcgagcaaagcccgcttattt<br>tttacatgccaatacaatgtaggctgctctacacctagttctgggcgagtttacgggttgttaaaccttcgat<br>tccgacctcattaagcagctctaatgcgctgttaatcactttatctaatctagacatcattaattcct<br>aatttttgttgacactctatcattgatagagttattttaccactccctatcagtgatagagaaagtgaaagga<br>ggtaaattATGACTAGTAAAGCAACAAAACTTGTGTTAGGCGCGGTTATACTTGGCTCCACCCTGCTTGCAGGT<br>TGCTCGTCTAACGCGAAGATCGACCAGGGTATCAATCCTTACGTCGGGTTTGAAATGGGATACGATTGGTTGGG<br>ACGTATGCCTTATAAGGGAAGTGTTGAAAACGGCGCTTATAAGGCGCAGGGAGTACAGTTAACGG |

TABLE 118-continued scFv Display Construct Sequences

| Description | Sequence |
|---|---|
| | CCAAGCTTGGGTACCCCATAACAGACGATTTAGATATTTATACCCGTTTAGGAGGAATGGTT<br>TGGAGAGCCGACACGAAGTCTAATGTATATGGTAAGAACCACGACACGGGAGTATCCCCCG<br>TCTTTGCAGGGGGAGTGGAATATGCTATCACACCAGAGATCGCTACCCGTTTGGAATATCAA<br>TGGACGAATAATATAGGCGACGCCCATACGATAGGAACGCGGCCCGACAACGGCATCCCTG<br>GGgtcGACTATAAGGATGACGACGACAAGcaattgGAAGTTCGCCTGTTGGAGAGCGGtGGtGGAC<br>TTGTGAAACCCGAGGGAAGCCTTAAACTTTCGTGCGTTGCTAGTGGGTTCACATTTTCAGACT<br>ATTTCATGTCCTGGGTCCGTCAAGCCCCGGGAAAAGGACTTGAATGGGTTGCCCATATTTAC<br>ACCAAGAGCTATAACTATGCCACATACTATTCTGGAAGCGTTAAAGGTCGTTTTACCATTTCG<br>CGTGACGACAGCCGTTCtATGGTGTATTTGCAGATGAATAACCTTCGTACAGAAGATACGGCT<br>ACTTACTACTGTACTCGCGATGGATCAGGCTATCCCAGTTTAGATTTCTGGGGACAGGGTACT<br>CAGGTTACTGTTTCAAGCGGTGGAGGCGGCTCTGGCGGTGGTGGGAGTGGAGGCGGTGGCA<br>GTTACGAGCTGACGCAGCCaCCCTCGGCAAGTGTAAACGTGGGCGAAACGGTGAAAATTACT<br>TGTTCGGGGGATCAACTGCCCAAATACTTCGCCGATTGGTTTCATCAACGTTCCGATCAGACT<br>ATTTTACAAGTGATTTATGATGATAACAAACGTCCGTCAGGAATCCCAGAGCGTATCAGCGG<br>ATCGAGCAGCGGAACAACAGCAACTTTGACCATCCGCGATGTCCGTGCCGAAGACGAGGGG<br>GACTACTATTGTTTCTCTGGATACGTGGACTCAGACAGCAAGCTGTATGTTTTGGCTCAGGA<br>ACACAACTGACCGTACTGGGCAAGGGCGAGCTCAATTCGAAGCTTGAAGGTAAGCCTATCCC<br>TAACCCTCTCCTCGGcCTCGATTCTACGCGTACCGGTCATCATCACCATCACCATTGAGCATG<br>CGAATTCGGTCTCaGGAGgAACGATTGGTAAACCCGGTGaacgcatgagAAAGCCCCCGGAAGATC<br>ACCTTCCGGGGGCTTTtttattgcgcGGACCAAAACGAAAAAAGACGCTCGAAAGCGTCTCTTTTCT<br>GGAATTTGGTACCGAGGcgtaatgctctgccagtgttacaaccaattaaccaattctgattagaaaaactcatc<br>gagcatcaaatgaaactgcaatttattcatatcaggattatcaataccatattttgaaaaagccgtttctgta<br>atgaaggagaaaactcaccgaggcagttccataggatggcaagatcctggtatcggtctgcgattccgactcgt<br>ccaacatcaatacaacctattaatttcccctcgtcaaaataaggttatcaagtgagaaatcaccatgagtgac<br>gactgaatccggtgagaatggcaaaagcttatgcatttctttccagacttgttcaacaggccagccattacgct<br>cgtcatcaaaatcactcgcatcaaccaaaccgttattcattcgtgattgcgcctgagcgagacgaaatacgcga<br>tcgctgttaaaggacaattacaaacaggaatcgaatgcaaccggcgcaggaacactgccagcgcatcaacaat<br>attttcacctgaatcaggatattcttctaatacctggaatgctgttttcccggggatcgcagtggtgagtaacc<br>atgcatcatcaggagtacggataaaatgcttgatggtcggaagaggcataaattccgtcagccagtttagtctg<br>accatctcatctgtaacatcattggcaacgctacctttgccatgtttcagaaacaactctggcgcatcgggctt<br>cccatacaatcgatagattgtcgcacctgattgcccgacattatcgcgagcccatttatacccatataaatcag<br>catccatgttggaatttaatcgcggcctcgagcaagacgtttcccgttgaatatggctcataacacccttgta<br>ttactgtttatgtaagcagacagttttattgttcatgatgatatattttatcttgtgcaatgtaacatcagag<br>attttgagacacaacgtggcttgttgaataaatcgaacttttgctggtgaaggatcagatcacgcatcttc<br>ccgacaacgcagaccgttccgtggcaaagcaaaagttcaaaatcaccaactggtccacctacaacaaagctctc<br>atcaaccgtggctccctcactttctggctggatgatgggcgattcaggcctggtatgagtcagcaacaccttc<br>ttcacgaggcagacctcagcgc |
| p15A-Kan-ptet-<br>IntiminN-FLAG-<br>J43scFv-V5-HIS<br>SEQ ID NO: 989 | tagcggagtgtatactggcttactatgttggcactgatgagggtgtcagtgaagtgcttcatgtggcaggagaa<br>aaaaggctgcaccggtgcgtcagcagaatatgtgatacaggatatattccgcttcctcgctcactgactcgcta<br>cgctcggtcgttcgactgcggcgagcggaaatggcttacgaacggggcggagatttcctggaagatgccaggaa<br>gatacttaacagggaagtgagagggccgcggcaaagcccgtttttccataggctccgcccccctgacaagcatca<br>cgaaatctgacgctcaaatcagtggtggcgaaacccgacaggactataaagataccaggcgtttccctggcgg<br>ctccctcgtgcgctctcctgttcctgccttcggtttaccggtgtcattccgctgttatggccgcgtttgtctc<br>attccacgcctgacactcagttccgggtaggcagttcgctccaagctggactgtatgcacgaaccccccgttca<br>gtccgaccgctgcgccttatccggtaactatcgtcttgagtccaacccggaaagacatgcaaaagcaccactgg<br>cagcagccactggtaattgatttagaggagttagtcttgaagtcatgcgccggttaaggctaaactgaaaggac<br>aagtttggtgactgcgctcctccaagccagttacctcggttcaaagagttggtagctcagagaaccttcgaaa<br>aaccgccctgcaaggcggttttttcgttttcagagcaagagattacgcgcagaccaaaacgatctcaagaagat<br>catcttattaaggggtctgacgctcagtggaacggtgcaccctgcagggctagctgataaagcgttcgcgctgc<br>attcggcagtttaagaccacttttcacatttaagttgttttctaatccgcatatgatcaattcaaggccgaat<br>aagaaggctggctctgcaccttggtgatcaaataattcgatagcttgtcgtaataatggcggcatactatcagt<br>agtaggtgtttcccttctctcttagcgacttgatgctcttgatcttccaatacgcaacctaaagtaaaatgcc<br>ccacagcgctgagtgcatataatgcattctctagtgaaaaaccttgttggcataaaaaggctaattgattttcg<br>agagtttcatactgtttttctgtaggccgtgtacctaaatgtactttttgctccatcgcgatgacttagtaaagc<br>acatctaaaacttttagcgttattacgtaaaaaatcttgccagctttcccccttctaaagggcaaaagtgagtat<br>ggtgcctatctaacatctcaatggctaaggcgtcgagcaaagcccgcttatttttttacatgccaatacaatgta<br>ggctgctctacacctagcttctgggcgagtttacgggttgttaaaccttcgattccgacctcattaagcagctc<br>taatgcgctgttaatcacttttacttttatctaatctagacatcattaattcctaattttttgttgacactctatc<br>attgatagagttatttttaccactccctatcagtgatagagaaaagtgaaaggaggtaaattATGACTAGTATTA<br>CGCATGGCTGTTATACCCGTACGCGTCATAAACACAAGTTGAAGAAAACTCTGATCATGTTATCCGCTG<br>GACTTGGACTTTTTTTTACGTGAATCAGAACTCTTTCGCTAATGGGGAAAATTATTTTAAAC<br>TGGGATCAGACAGCCAAATTACTTACGCATGACTCATACCAGATCGTCTGTTTTATACGCTG<br>AAAACTGGTGAaACCGTTGCAGATTTAAGTAAAAGTCAGGACATTAACCTGTCAACTATTTG<br>GTCACTTAATAAACACTTATATTCGAGCGAATCGGAAATGATGAAAGCTGCACCGGGGCAAC<br>AAATCATCTTGCCCCTGAAGAAATTGCCCTTTGAATACTCCGCTTTGCCCTTGCTGGGCTCGG<br>CTCCTCTGGTAGCCGCCGGAGGCGTTGCCGGTCACACTAATAAGCTGACAAAAATGTCACCC<br>GACGTGACGAAGAGCAACATGACGGATGATAAGGCTTTAAATTACGCAGCTCAGCAAGCGG<br>CCTGCGTTGGGAAGTCAGTTACGAGTCGTTCGTTAAATGGTGATTATGCTAAGGATACCGCA<br>TTGGGTATTGCCGGCAACCAAGCGTCGAGCCAACTTCAGGCATGGTTGCAACATTACGGCAC<br>TGCTGAAGTAAATCTGCAATCAGGTAATAATTTTGACGGTAGTTCCCTGGATTTCCTTTTACC<br>TTTTTACGATTCAGAAAAGATGTTGGCTTTCGGACAGGTGGGGGCGCGTTACATCGATTCAC<br>GTTTTACCGCTAACTTGGGGGCCGGTCAACGCTTCTTCTTACCTGCCAATATGTTGGGCTATA<br>ATGTATTTATCGACCAGGACTTCAGTGGTGACAATACACGTCTGGGAATTGGTGGAGAGTAtT<br>GGCGCGATTACTTTAAGTCATCTGTAAATGGCTATTTTCGCATGAGCGGTTGGCATGAAAGTT<br>ACAACAAGAAAGACTACGATGAGCGCCCCGCGAACGGGTTTGACATCCGTTTTAATGGTTAT |

TABLE 118-continued scFv Display Construct Sequences

| Description | Sequence |
|---|---|
| | TTGCCATCTTATCCCGCCTTGGGAGCTAAATTAATCTACGAGCAATACTATGGAGATAACGT
AGCTTTGTTTAATAGCGACAAGTTACAGTCTAATCCAGGAGCGGCTACAGTGGGAGTTAATT
ATACCCCAATCCCACTGGTCACAATGGGAATCGATTATCGCCACGGGACTGGTAATGAAAAC
GATTTATTATACTCCATGCAGTTTCGTTATCAGTTCGATAAGAGTTGGTCGCAGCAGATTGAG
CCTCAATATGTTAACGAATTACGTACCTTGTCCGGCAGTCGCTACGATCTGGTACAACGCAA
TAACAATATCATCCTTGAGTATAAGAAACAGGACATTCTGTCTTTGAACATTCCACATGATAT
TAATGGTACCGAGCACTCAACACAAAAAATTCAGCTGATTGTGAAATCAAAGTATGGACTGG
ACCGTATCGTGTGGGATGATAGCGCTCTGCGCAGTCAGGGTGGACAGATCCAGCACTCGGGT
AGCCAGTCTGCCCAAGACTACCAGGCTATCCTGCCAGCGTATGTCCAAGGGGGAAGTAACAT
CTACAAAGTTACAGCTCGCGCCTATtACCGCAACGGTAATTCTAGTAATAATGTGCAGTTGAC
AATTACGGTGCTGTCCAATGGGCAGGTCGTCGATCAGGTAGGTGTGACGGATTTTACAGCCG
ATAAAACCTCTGCGAAGGCAGATAACGCGGATACCATCACATACACTGCCACTGTAAAAAA
AAACGGTGTCGCGCAGGCAAACGTTCCTGTTAGCTTCAACATCGTGTCGGGTACAGCCACCC
TTGGGGCCAACTCGGCAAAGACTGACGCGAATGGCAAGGCTACAGTCACGTTGAAATCCTC
GACACCAGGACAGGTCGTTGTGTCTGCCAAGACAGCAGAGATGACCTCCGCCCTTAATGCAT
CTGCTGTTATCTTCTTCGATCAAACGAAGGCATCTgtcGACTATAAGGATGACGACGACAAGca
attgGAAGTTCGCCTGTTGGAGAGCGGtGGtGGACTTGTGAAACCCGAGGGAAGCCTTAAACTTT
CGTGCGTTGCTAGTGGGTTCACATTTTCAGACTATTTCATGTCCTGGGTCCGTCAAGCCCCGG
GAAAAGGACTTGAATGGGTTGCCCATATTTACACCAAGAGCTATAACTATGCCACATACTAT
TCTGGAAGCGTTAAAGGTCGTTTTACCATTTCGCGTGACGACAGCCGTTCtATGGTGTATTTG
CAGATGAATAACCTTCGTACAGAAGATACGGCTACTTACTACTGTACTCGCGATGGATCGAG
CTATCCCAGTTTAGATTTCTGGGGACAGGGTACTCAGGTTACTGTTTCAAGCGGTGGAGGCG
GCTCTGGCGGTGGTGGGAGTGGAGGCGGTGGCAGTTACGAGCTGACGCAGCCaCCCTCGGCA
AGTGTAAACGTGGGCGAAACGGTGAAAATTACTTGTTCGGGGGATCAACTGCCCAAATACTT
CGCCGATTGGTTTCATCAACGTTCCGATCAGACTATTTTACAAGTGATTTATGATGATAACAA
ACGTCCGTCAGGAATCCCAGAGCGTATCAGCGGATCGAGCAGCGGAACAACAGCAACTTTG
ACCATCCGCGATGTCCGTGCCGAAGACGAGGGGGACTACTATTGTTTCTCTGGATACGTGGA
CTCAGACAGCAAGCTGTATGTTTTGGCTCAGGAACACAACTGACCGTACTGGGCAAGGGCG
AGCTCAATTCGAAGCTTGAAGGTAAGCCTATCCCTAACCCTCTCCTCGGcCTCGATTCTACGC
GTACCGGTCATCATCACCATCACCATTGAGCATGCTAATCAGCCGTGGAATTCGCAACGTAA
AAAAACCCGCCCGGCGGGTTTTTTTATACCGGTCTCaGGAGgAACGATTGGTAAACCCGGTG
aacgcatgagAAAGCCCCCGGAAGATCACCTTCCGGGGGCTTTtttattgcgcGGACCAAAACGAAAA
AGACGCTCGAAAGCGTCTCTTTTCTGGAATTTGGTACCGAGGcgtaatgctctgccagtgttacaaccaattaa
ccaattctgattagaaaaactcatcgagcatcaaatgaaactgcaatttattcatatcaggattatcaatacca
tatttttgaaaaagccgtttctgtaatgaaggagaaaactcaccgaggcagttccataggatggcaagatcctg
gtatcggtctgcgattccgactcgtccaacatcaatcaacctattaatttcccctcgtcaaaaataaggttat
caagtgagaaatcaccatgagtgacgactgaatccggtgagaatggcaaaagcttatgcatttctttccagact
tgttcaacaggccagccattacgctcgtcatcaaaatcactcgcatcaaccaaaccgttattcattcgtgattg
cgcctgagcgagacgaaatacgcgatcgctgttaaaaggacaattacaaacaggaatcgaatgcaaccggcgca
ggaacactgccagcgcatcaacaatattttcacctgaatcaggatattcttctaatacctggaatgctgttttc
ccgggatcgcagtggtgagtaaccatgcatcatcaggagtacggataaaatgcttgatggtcggaagaggcat
aaattccgtcagccagtttagtctgaccatctcatctgtaacatcattggcaacgctaccttttgccatgtttca
gaaacaactctggcgcatcgggcttcccatacaatcgatagattgtcgcacctgattgcccgacattatcgcga
gcccatttataccatataaatcagcatccatgttggaatttaatcgcggcctcgagcaagacgtttcccgttg
aatatggctcataacaccccttgtattactgtttatgtaagcagacagttttattgttcatgatgatatatttt
tatcttgtgcaatgtaacatcagagattttgagacacaagctggctttgttgaataaatcgaacttttgctgag
ttgaaggatcagatcacgcatcttcccgacaacgcagaccgttccgtggcaaagcaaaagttcaaaatcaccaa
ctggtccacctacaacaaagctctcatcaaccgtggctccctcactttctggctggatgatggggcgattcagg
cctggtatgagtcagcaacaccttcttcacgaggcagacctcagcgc |

TABLE 119

Selected display anchors

| Invasin display tag SEQ ID NO: 990 | MVFQPISEFLLIRNAGMSMYFNKIISFNIISRIVICIFLICGMFMAGASEKYDANAPQQV
QPYSVSSSAFENLHPNNEMESSINPFSASDTERNAAIIDRANKEQETEAVNKMISTGARL
AASGRASDVAHSMVGDAVNQEIKQWLNRFGTAQVNLNFDKNFSLKESSLDWLAPWYDSAS
FLFFSQLGIRNKDSRNTLNLGVGIRTLENGWLYGLNTFYDNDLTGHNHRIGLGAEAWTDY
LQLAANGYFRLNGWHSSRDFSDYKERPATGGDLRANAYLPALPQLGGKLMYEQYTGERVA
LFGKDNLQRNPYAVTAGINYTPVPLLTVGVDQRMGKSSKHETQWNLQMNYRLGESFQSQL
SPSAVAGTRLLAESRYNLVDRNNNIVLEYQKQQVVKLTLSPATISGLPGQVYQVNAQVQG
ASAVREIVWSDAELIAAGGTLTPLSTTQFNLVLPPYKRTAQVSRVTDDLTANFYSLSALA
VDHQGNRSNSFTLSVTVQQPQLTLTAAVIGDGAPANGKTAITVEFTVADFEGKPLAGQEV
VITTNNGALPNKITEKTDANGVARIALTNTTDGVTVVTAEVEGQRQSVDTHFVKGTIAAD
KSTLAAV |

TABLE 119-continued

Selected display anchors

| | |
|---|---|
| LppOmpA display tag SEQ ID NO: 991 | KATKLVLGAVILGSTLLAGCSSNAKIDQGINPYVGFEMGYDWLGRMPYKGSVENGAYKAQ GVQLTAKLGYPITDDLDIYTRLGGMVWRADTKSNVYGKNHDTGVSPVFAGGVEYAITPEI ATRLEYQWTNNIGDAHTIGTRPDNGIPG |
| IntiminN display tag SEQ ID NO: 992 | ITHGCYTRTRHKHKLKKTLIMLSAGLGLFFYVNQNSFANGENYFKLGSDSKLLTHDSYQN RLFYTLKTGETVADLSKSQDINLSTIWSLNKHLYSSESEMMKAAPGQQIILPLKKLPFEY SALPLLGSAPLVAAGGVAGHTNKLTKMSPDVTKSNMTDDKALNYAAQQAASLGSQLQSRS LNGDYAKDTALGIAGNQASSQLQAWLQHYGTAEVNLQSGNNFDGSSLDFLLPFYDSEKML AFGQVGARYIDSRFTANLGAGQRFFLPANMLGYNVFIDQDFSGDNTRLGIGGEYWRDYFK SSVNGYFRMSGWHESYNKKDYDERPANGFDIRFNGYLPSYPALGAKLIYEQYYGDNVALF NSDKLQSNPGAATVGVNYTPIPLVTMGIDYRHGTGNENDLLYSMQFRYQFDKSWSQQIEP QYVNELRTLSGSRYDLVQRNNNIILEYKKQDILSLNIPHDINGTEHSTQKIQLIVKSKYG LDRIVWDDSALRSQGGQIQHSGSQSAQDYQAILPAYVQGGSNIYKVTARAYYRNGNSSNN VQLTITVLSNGQVVDQVGVTDFTADKTSAKADNADTITYTATVKKNGVAQANVPVSFNIV SGTATLGANSAKTDANGKATVTLKSSTPGQVVVSAKTAEMTSALNASAVIFFDQTKAS |

In some embodiments, the scFv Display Construct Sequence is at least about 80%, at least about 85%, at least about 90%, at least about 95%, or at least about 99% homologous to the sequence of SEQ ID NO: 987, SEQ ID NO: 988, and/or SEQ ID NO: 989.

In some embodiments, the display anchor is at least about 80%, at least about 85%, at least about 90%, at least about 95%, or at least about 99% homologous to the sequence of SEQ ID NO: 990, SEQ ID NO: 991, and/or SEQ ID NO: 992.

E. coli Nissle comprising a plasmid based construct comprising tet-inducible ptet-LppOmpA-anti-PD1-scFv was grown overnight in LB medium. Cultures were diluted 1:100 in LB and grown shaking (200 rpm) to an optical density of 0.8 at which time culture was cooled down to room temperature and anhydrous tetracycline (ATC) was added to cultures at a concentration of 100 ng/mL to induce expression of ptet-LppOmpA-J43-scFv for 18 hours.

To determine whether the single-chain antibody was displayed on the surface of the genetically engineered E. coli Nissle and functionally binds to PD1 a whole cell ELISA assay was performed. 10^9 cells were blocked using PBS with 2% BSA for 1 h at room temperature and biotinylated-mPD1 was added and incubated for 1 h at room temperature. Afterwards, cells were washed 3 times with PBST (PBS/ 0.1% Tween-20) and incubated with a streptavidin conjugated HRP in blocking solution for 40 min. Following incubation, wells were washed 3 times with PBST and resuspended in PBS, then stained using a 3,3',5,5'-tetramethylbenzidine (TMB) substrate kit per the manufacturer's instructions (Thermofisher). Biotinylated IgG and plain PBS were used instead of mPD1 as negative controls. Cells were removed by centrifugation and supernatants were collected. Signal intensities of supernatant were measured using an ELISA reader at 450 nm. Results are shown in Table 120 and indicate that the J43-scFv (anti-mPD1) is displayed on the surface of the genetically engineered bacteria and can bind to mPD1.

TABLE 120

Nissle Surface Display ELISA Assay

| Strain | OD450 | Primary antibody | Secondary antibody |
|---|---|---|---|
| SYN2798 (p15A-ptet-LppOmpA-anti-PD1-scFv) | 0.125 | PBS only | Strp-HRP |
| SYN2798 (p15A-ptet-LppOmpA-anti-PD1-scFv) | 0.133 | mIgG-strp | Strp-HRP |
| SYN2798 (p15A-ptet-LppOmpA-anti-PD1-scFv) | 0.421 | mPD1-strp | Strp-HRP |

Example 57. Anti-CD47 scFv Expression in E. coli

To determine whether a functional anti-CD47-scFv can be expressed in E. coli, an anti-CD47-scFv fragment was generated based on B6H12 and 5F9 monoclonal antibodies, which reacts with human CD47.

Monoclonal antibody B6H12 and 5F9 (anti human CD47) sequences were obtained from published patent (US 20130142786 A1). Next, the single-chain variable fragment (scFv) targeting human CD47 was designed. A fragment containing tet promoter, a ribosome binding site, the designed antihCD47-scFv, a C terminal V5 tag and a C terminal hexa-histidine tag was synthesized by IDTDNA. The construct was cloned into the pCR™-Blunt II-TOPO® Vector (Invitrogen) and transformed into E. coli DH5a as described herein to generate the plasmid pUC-ptet-B6H12antihCD47scFv-V5-HIS (SEQ ID NO: 19) and pUC-ptet-5F9antihCD47scFv-V5-HIS (SEQ ID NO: 21), shown in Table 121.

TABLE 121

Anti-CD47 scFv sequences

| Description | Sequence |
|---|---|
| pUC-ptet-<br>B6H12antihCD47scFv-<br>V5-HIS<br>SEQ ID NO: 993 | AGCGCCCAATACGCAAACCGCCTCTCCCCGCGCGTTGGCCGATTCATTAATGCAGCTGGCACGA<br>CAGGTTTCCCGACTGGAAAGCGGGCAGTGAGCGCAACGCAATTAATGTGAGTTAGCTCACTCAT<br>TAGGCACCCCAGGCTTTACACTTTATGCTTCCGGCTCGTATGTTGTGTGGAATTGTGAGCGGATA<br>ACAATTTCACACAGGAAACAGCTATGACCATGATTACGCCAAGCTATTTAGGTGACACTATAGA<br>ATACTCAAGCTATGCATCAAGCTTGGTACCGAGCTCGGATCCACTAGTAACGCCGCCAGTGTG<br>CTGGAATTCGCCCTTtaagacccactttcacatttaagttgttttctaatccgcagatgatcaa<br>ttcaaggccgaataagaaggctggctctgcaccttggtgatcaaataattcgatagcttgtcgtaa<br>taatggcggcatactatcagtagtaggtgtttcccttctcttagcgacttgatgctcttgatc<br>ttccaatacgcaacctaaagtaaaatgccccacagcgctgagtgcatataatgcattctctagtga<br>aaaaccttgttggcataaaaaggctaattgattttcgagagtttcatactgttttctgtaggccg<br>tgtacctaaatgtacttttgctccatcgcgatgacttagtaaagcacatctaaaacttttagcgtt<br>attacgtaaaaaatcttgccagctttccccttctaaagggcaaaagtgagtatggtgcctatctaa<br>catctcaatggctaaggcgtcgagcaaagcccgcttattttttacatgccaatacaatgtaggctg<br>ctctacacctagcttctgggcgagtttacgggttgttaaaccttcgattccgacctcattaagcag<br>ctctaatgcgctgttaatcactttacttttatctaatctagacatcattaattcctaatttttgtt<br>gacactctatcattgatagagttattttaccactccctatcagtgatagagaaaagtgaaaggagg<br>taaattCATatgactagtcaattgggtggtagcGAGGTCCAGCTGGTGGAATCTGGCGGAGACTTA<br>GTAAAGCCGGGAGGTTCGTTGAAGTTGAGTTGCGCTGCTAGTGGGTTTACGTTTAGCGGCTATGGT<br>ATGTCATGGGTCCGCCAAACACCCGATAAACGTTTAGAGTGGGTCGCCACGATTACGAGTGGAGGC<br>ACCTACACCTATTATCCGGATTCTGTCAAAGGCCGCTTTACTATTTCTCGTGATAATGCAAAGAAC<br>ACCTTATATTTACAGATCGACTCCTTGAAGTCTGAGGATACCGCAATTTATTTCTGTGCCCGTTCG<br>TTAGCCGGTAATGCTATGGATTATTGGGGCAAGGCACATCTGTCACAGTCTCATCCGGAGGAGGC<br>GGATCAGGTGGTGGCGGTTCTGGCGGCGGCGGATCTGACATTGTGATGACACAATCACCTGCGACA<br>CTTTCGGTTACTCCAGGAGACCGCGTTAGCTTGTCGTGTCGCGCCTCTCAAACCATCAGTGACTAC<br>TTACATTGGTACCAACAGAAATCCCATGAATCGCCACGCTTACTTTATTAAGTTTGCGTCCCAATCA<br>ATTAGTGGTATTCCGTCGCGCTTTAGTGGTAGCGGTTCTGGTTCTGATTTCACATTGTCAATCAAC<br>AGCGTGGAGCCGGAGGATGTTGGTGTTTACTACTGCCAAAACGGTCACGGCTTTCCACGTACATTC<br>GGAGGGGGAACGAAGTTGGAAATTAAAggcagcGGCGAGCTCggtggcagtGGTAAGCCTATCCCT<br>AACCCTCTCCTCGGcCTCGATTCTACGggatccggtCATCATCACCATCACCATTGAGCATGCTAA<br>TCAGCCGTGGAATTCGAATTCGGTCTCaggaGgAAGGGCGAATTCTGCAGATATCCATCACACTGG<br>CGGCCGCTCGAGCATGCATCTAGAGGGCCCAATTCGCCCTATAGTGAGTCGTATTACAATTCACTG<br>GCCGTCGTTTTACAACGTCGTGACTGGGAAAACCCTGGCGTTACCCAACTTAATCGCCTTGCAGCA<br>CATCCCCCTTTCGCCAGCTGGCGTAATAGCGAAGAGGCCCGCACCGATCGCCCTTCCCAACAGTTG<br>CGCAGCCTATACGTACGGCAGTTTAAGGTTTACACCTATAAAAGAGAGCCGTTATCGTCTGTTT<br>GTGGATGTACAGAGTGATATTATTGACACGCCGGGCGACGGATGGTGATCCCCCTGGCCAGTGCA<br>CGTCTGCTGTCAGATAAAGTCTCCCGTGAACTTTACCCGGTGGTGCATATCGGGGATGAAAGCTGG<br>CGCATGATGACCACCGATATGGCCAGTGTGCCGGTCTCCGTTATCGGGGAAGAAGTGGCTGATCTC<br>AGCCACCGCGAAAATGACATCAAAAACGCCATTAACCTGATGTTCTGGGGAATATAAATGTCAGGC<br>ATGAGATTATCAAAAAGGATCTTCACCTAGATCCTTTTCACGTAGAAAGCCAGTCCGCAGAAACGG<br>TGCTGACCCCGGATGAATGTCAGCTACTGGGCTATCTGGACAAGGGAAAACGCAAGCGCAAAGAGA<br>AAGCAGGTAGCTTGCAGTGGGCTTACATGGCGATAGCTAGACTGGGCGGTTTTATGGACAGCAAGC<br>GAACCGGAATTGCCAGCTGGGGCGCCCTCTGGTAAGGTTGGGAAGCCCTGCAAAGTAAACTGGATG<br>GCTTTCTCGCCGCCAAGGATCTGATGGCGCAGGGGATCAAGCTCTGATCAAGAGACAGGATGAGGA<br>TCGTTTCGCATGATTGAACAAGATGGATTGCACGCAGGTTCTCCGGCCGCTTGGGTGGAGAGGCT<br>ATTCGGCTATGACTGGGCACAACAGACAATCGGCTGCTCTGATGCCGCCGTGTTCCGGCTGTCAG<br>CGCAGGGGCGCCCGGTTCTTTTTGTCAAGACCGACCTGTCCGGTGCCCTGAATGAACTGCAAGAC<br>GAGGCAGCGCGGCTATCGTGGCTGGCCACGACGGGCGTTCCTTGCGCAGCTGTGCTCGACGTTG<br>TCACTGAAGCGGGAAGGGACTGGCTGCTATTGGGCGAAGTGCCGGGGCAGGATCTCCTGTCATC<br>TCACCTTGCTCCTGCCGAGAAAGTATCCATCATGGCTGATGCAATGCGGCGGCTGCATACGCTTG<br>ATCCGGCTACCTGCCCATTCGACCACCAAGCGAAACATCGCATCGAGCGAGCACGTACTCGGAT<br>GGAAGCCGGTCTTGTCGATCAGGATGATCTGGACGAAGAGCATCAGGGGCTCGCGCCAGCCGAA<br>CTGTTCGCCAGGCTCAAGGCGAGCATGCCCGACGGCGAGGATCTCGTCGTGACCCATGGCGATG<br>CCTGCTTGCCGAATATCATGGTGGAAAATGGCCGCTTTTCTGGATTCATCGACTGTGGCCGGCTG<br>GGTGTGGCGGACCGCTATCAGGACATAGCGTTGGCTACCCGTGATATTGCTGAAGAGCTTGGCG<br>GCGAATGGGCTGACCGCTTCCTCGTGCTTTACGGTATCGCCGCTCCCGATTCGCAGCGCATCGCC<br>TTCTATCGCCTTCTTGACGAGTTCTTCTGAATTATTAACGCTTACAATTTCCTGATCGGTATTTT<br>CTCCTTACGCATCTGTGCGGTATTTCACACCGCATACAGGTGGCACTTTTCGGGGAAATGTGCGC<br>GGAACCCCTATTTGTTTATTTTTCTAAATACATTCAAATATGTATCCGCTCATGAGACAATAACCC<br>TGATAAATGCTTCAATAATAGCACGTGAGGAGGGCCACCATGCCAAGTTGACCAGTGCCGTTC<br>CGGTGCTCACCGCGCGCGACGTCGCCGGAGCGGTCGAGTTCTGGACCGACCGGCTCGGGTTCTC<br>CCGGGACTTCGTGGAGGACGACTTCGCCGGTGTGGTCCGGGACGACGTGACCCTGTTCATCAGC<br>GCGGTCCAGGACCAGGTGGTGCCGGACAACACCCTGGCCTGGGTGTGGGTGCGGGCCTGGACG<br>AGCTGTACGCCGAGTGGTCGGAGGTCGTGTCCACGAACTTCCGGGACGCCTCCGGGCCGGCCAT<br>GACCGAGATCGGCGAGCAGCCGTGGGGCGGGAGTTCGCCCTGCGCGACCCGGCCGGCAACTG<br>CGTGCACTTCGTGGCCGAGGAGCAGGACTGACACGTGCTAAAACTTCATTTTTAATTTAAAAGG<br>ATCTAGGTGAAGATCCTTTTTGATAATCTCATGACCAAAATCCCTTAACGTGAGTTTTCGTTCCAC<br>TGAGCGTCAGACCCCGTAGAAAAGATCAAAGGATCTTCTTGAGATCCTTTTTTCTGCGCGTAAT<br>CTGCTGCTTGCAAACAAAAAAACCACCGCTACCAGCGGTGGTTTGTTTGCCGGATCAAGAGCTA<br>CCAACTCTTTTTCCGAAGGTAACTGGCTTCAGCAGAGCGCAGATACCAAATACTGTCCTTCTAGT<br>GTAGCCGTAGTTAGGCCACCACTTCAAGAACTCTGTAGCACCGCCTACATACCTCGCTCTGCTAA<br>TCCTGTTACCAGTGGCTGCTGCCAGTGGCGATAAGTCGTGTCTTACCGGGTTGGACTCAAGACGA<br>TAGTTACCGGATAAGGCGCAGCGGTCGGGCTGAACGGGGGGTTCGTGCACACAGCCCAGCTTGG<br>AGCGAACGACCTACACCGAACTGAGATACCTACAGCGTGAGCTATGAGAAAGCGCCACGCTTCC<br>CGAAGGGAGAAAGGCGGACAGGTATCCGGTAAGCGGCAGGGTCGGAACAGGAGAGCGCACGA<br>GGGAGCTTCCAGGGGGAAACGCCTGGTATCTTTATAGTCCTGTCGGGTTTCGCCACCTCTGACTT<br>GAGCGTCGATTTTTGTGATGCTCGTCAGGGGGGCGGAGCCTATGGAAAAACGCCAGCAACGCGG |

TABLE 121-continued

Anti-CD47 scFv sequences

| Description | Sequence |
|---|---|
| | CCTTTTTACGGTTCCTGGGCTTTTGCTGGCCTTTTGCTCACATGTTCTTTCCTGCGTTATCCCCT<br>GATTCTGTGGATAACCGTATTACCGCCTTTGAGTGAGCTGATACCGCTCGCCGCAGCCGAACGAC<br>CGAGCGCAGCGAGTCAGTGAGCGAGGAAGCGGAAG |
| B6H12-anti-CD47-scFv<br>polypeptide sequence<br>SEQ ID NO: 994 | EVQLVESGGDLVKPGGSLKLSCAASGFTFSGYGMSWVRQTPDKRLEWVATITSGGTYTYY<br>PDSVKGRFTISRDNAKNTLYLQIDSLKSEDTAIYFCARSLAGNAMDYWGQGTSVTVSSGG<br>GGSGGGGSGGGGSDIVMTQSPATLSVTPGDRVSLSCRASQTISDYLHWYQQKSHESPRLL<br>IKFASQSISGIPSRFSGSGSGSDFTLSINSVEPEDVGVYYCQNGHGFPRTFGGGTKLEIK |
| pUC-ptet-<br>5F9antihCD47scFv-<br>V5-HIS<br>SEQ ID NO: 995 | AGCGCCCAATACGCAAACCGCCTCTCCCCGCGCGTTGGCCGATTCATTAATGCAGCTGGCACGA<br>CAGGTTTCCCGACTGGAAAGCGGGCAGTGAGCGCAACGCAATTAATGTGAGTTAGCTCACTCAT<br>TAGGCACCCCAGGCTTTACACTTTATGCTTCCGGCTCGTATGTTGTGTGGAATTGTGAGCGGATA<br>ACAATTTCACACAGGAAACAGCTATGACCATGATTACGGATTACTATAGA<br>ATACTCAAGCTATGCATCAAGCTTGGTACCGAGCTCGGATCCACTAGTAACGGCCGCCAGTGTG<br>CTGGAATTCGCCCTTttaagacccactttcacatttaagttgtttttctaatccgcagatgatca<br>attcaaggccgaataagaaggctggctctgcaccttggtgatcaaataattcgatagcttgtcgt<br>aataatggcggcatactatcagtagtaggtgtttcccttcttctttagcgacttgatgctcttg<br>atcttccaatacgcaacctaaagtaaaatgccccacagcgctgagtgcatataatgcattctct<br>agtgaaaaaccttgttggcataaaaaggctaattgattttcgagagtttcatactgttttctgtag<br>gccgtgtacctaaatgtacttttgctccatcgcgatgacttagtaaagcacatctaaaacttttagc<br>gttattacgtaaaaaatcttgccagcttttcccttctaaaggggcaaaagtgagtatggtgcctatct<br>aacatctcaatggctaaggcgtcgagcaaagcccgcttatttttacatgccaatacaatgtaggct<br>gctctacacctagcttctgggcgagtttacgggttgttaaaccttcgattccgacctcattaagcag<br>ctctaatgcgctgttaatcactttacttttatctaatctagacatcattaattcctaattttttgttg<br>acactctatcattgatagagtttattttaccactccctatcagtgatagagaaaagtgaaaggaggta<br>aattCATatgactagtcaattgggtggtagcCAGGTGCAGCTTGTGCAGAGTGGCGCTGAAGTGAAGA<br>AACCGGGCGCATCAGTGAAAGTGAGCTGCAAAGCAAGCGGTTATACCTTCACGAACTATAACATGCA<br>CTGGGTACGTCAAGCACCCGGCCAGCGTCTTGAGTGGATGGGCACCATTTATCCTGGAAACGACGAC<br>ACATCCTACAACCAAAAGTTTAAGGACCGCGTAACTATCACTGCTGACACTTCAGCTTCCACAGCAT<br>ATATGGAGCTTAGTAGCCTGCGTAGTGAAGACACAGCGGTCTACTACTGCGCACGTGGAGGGTATCG<br>TGCGATGGACTACTGGGGCAGGGCACACTTGTGACTGTTTCATCTGGCGGTGGAGGCTCTGGAGGG<br>GGGGGTAGCGGGGGGGGCGGTAGCGATATCGTAATGACTCAGTCCCCACTTTCCTTACCCGTCACAC<br>CGGGCGAACCTGCTATTAGCTGTCGTCGTCGCAAAGCATTGTTTACTCGAATGGGAATACGTACTT<br>GGGGTGCATGTACAAAAACCAGGGCAGTCCCCTCAGTTGTTGATCTACAAGGTGTCCAACCGCTTTA<br>GTGTCTTGGGTGCCTGATCGTTTCTCTGGCAGTGGTAGTGGTACCGACTTCACGCTTAAAATTTCCC<br>GTGTCGAAGCAGAAGACGTTGGCGTATATTACTGCTTCCAAGGCAGTCATGTGCCATACACGTTCGG<br>GCAAGGCACCAAACTTGAGATCAAAggcagcGGCGAGCTCggtggcagtGGTAAGCCTATCCCTAAC<br>CCTCTCCTCGGcCTCGATTCTACGgatccggtCATCATCACCATCACCATTGAGCATGCTAATCAG<br>CCGTGGAATTCGAATTCGGTCTCaGGAGgAAGGGCGAATTCTGCAGATATCCATCACACTGGCGGCC<br>GCTCGAGCATGCATCTAGAGGGCCCAATTCGCCCTATAGTGAGTCGTATTACAATTCACTGGCCGTC<br>GTTTTACAACGTCGTGACTGGGAAAACCCTGGCGTTACCCAACTTAATCGCCTTGCAGCACATCCCC<br>CTTTCGCCAGCTGGCGTAATAGCGAAGAGGCCCGCACCGATCGCCCTTCCCAACAGTTGCGCAG<br>CCTATACGTACGGCAGTTTAAGGTTTACACCTATAAAAGAGAGAGCCGTTATCGTCTGTTTGTGG<br>ATGTACAGAGTGATATTATTGACACGCCGGGGCGACGGATGGTGATCCCCTGGCCAGTGCACG<br>TCTGCTGTCAGATAAAGTCTCCCGTGAACTTTACCCGGTGGTGCATATCGGGGATGAAAGCTGGC<br>GCATGATGACCACCGATATGGCCAGTGTGCCGGTCTCCGTTATCGGGGAAGAAGTGGCTGATCT<br>CAGCCACCGCGAAAATGACATCAAAAACGCCATTAACCTGATGTTCTGGGGAATATAAATGTCA<br>GGCATGAGATTATCAAAAGGATCTTCACCTAGATCCTTTTCACGTAGAAAGCCAGTCCGCAGA<br>AACGGTGCTGACCCCGGATGAATGTCAGCTACTGGGCTATCTGGACAAGGGAAAACGCAAGCGC<br>AAAGAGAAAGCAGGTAGCTTGCAGTGGGCTTACATGGCGATAGCTAGACTGGGCGGTTTTATGG<br>ACAGCAAGCGAACCGGAATTGCCAGCTGGGGCGCCCTCTGGTAAGGTTGGGAAGCCCTGCAAAG<br>TAAACTGGATGGCTTTCTCGCCGCCAAGGATCTGATGGCGCAGGGGATCAAGCTCTGATCAAGA<br>GACAGGATGAGGATCGTTTCGCATGATTGAACAAGATGGATTGCACGCAGGTTCTCCGGCCGCT<br>TGGGTGGAGAGGCTATTCGGCTATGACTGGGCACAACAGACAATCGGCTGCTCTGATGCCGCCG<br>TGTTCCGGCTGTCAGCGCAGGGGCGCCCGGTTCTTTTTGTCAAGACCGACCTGTCCGGTGCCCTG<br>AATGAACTGCAAGACGAGGCAGCGCGGCTATCGTGGCTGGCCACGACGGGCGTTCCTTGCGCAG<br>CTGTGCTCGACGTTGTCACTGAAGCGGGAAGGGACTGGCTGCTATTGGGCGAAGTGCCGGGGCA<br>GGATCTCCTGTCATCTCACCTTGCTCCTGCCGAGAAAGTATCCATCATGGCTGATGCAATGCGGC<br>GGCTGCATACGCTTGATCCGGCTACCTGCCCATTCGACCACCAAGCGAAACATCGCATCGAGCG<br>AGCACGTACTCGGATGGAAGCCGGTCTTGTCGATCAGGATGATCTGGACGAAGAGCATCAGGGG<br>CTCGCGCCAGCCGAACTGTTCGCCAGGCTCAAGGCGAGCATGCCCGACGGCGAGGATCTCGTCG<br>TGACCCATGGCGATGCCTGCTTGCCGAATATCATGGTGGAAAATGGCCGCTTTTCTGGATTCATC<br>GACTGTGGCCGGCTGGGTGTGGCGGACCGCTATCAGGACATAGCGTTGGCTACCCGTGATATTG<br>CTGAAGAGCTTGGCGGCGAATGGGCTGACCGCTTCCTCGTGCTTTACGGTATCGCCGCTCCCGAT<br>TCGCAGCGCATCGCCTTCTATCGCCTTCTTGACGAGTTCTTCTGAATTATTAACGCTTACAATTTC<br>CTGATGCGGTATTTTCTCCTTACGCATCTGTGCGGTATTTCACACCGCATACAGGTGGCACTTTTC<br>GGGGAAATGTGCGCGGAACCCCTATTTGTTTATTTTTCTAAATACATTCAAATATGTATCCGCTC<br>ATGAGACAATAACCCTGATAAATGCTTCAATAATAGCACGTGAGGAGGGCCACCATGGCCAAGT<br>TGACCAGTGCCGTTCCGGTGCTCACCGCGCGACGTCGCCGGAGCGGTCGAGTTCTGGACCGA<br>CCGGCTCGGGTTCTCCCGGGACTTCGTGGAGGACGACTTCGCCGGTGTGGTCCGGGACGACGTG<br>ACCCTGTTCATCAGCGCGGTCCAGGACCAGGTGGTGCCGGACAACCCCTGGCCTGGGTGTGGG<br>TGCGCGGCCTGGACGAGCTGTACGCCGAGTGGTCGGAGGTCGTGTCCACGAACTTCCGGGACGC<br>CTCCGGGCCGGCCATGACCGAGATCGGCGAGCAGCCGTGGGGCGGGAGTTCGCCCTGCGCGAC<br>CCGGCCGGCAACTGCGTGCACTTCGTGGCCGAGGAGCAGGACTGACACGTGCTAAAACTTCATT<br>TTTAATTTAAAAGGATCTAGGTGAAGATCCTTTTTGATAATCTCATGACCAAAATCCCTTAACGT<br>GAGTTTTCGTTCCACTGAGCGTCAGACCCCGTAGAAAAGATCAAAGGATCTTCTTGAGATCCTTT |

TABLE 121-continued

Anti-CD47 scFv sequences

| Description | Sequence |
|---|---|
| | TTTTCTGCGCGTAATCTGCTGCTTGCAAACAAAAAAACCACCGCTACCAGCGGTGGTTTGTTTGC<br>CGGATCAAGAGCTACCAACTCTTTTTCCGAAGGTAACTGGCTTCAGCAGAGCGCAGATACCAAA<br>TACTGTCCTTCTAGTGTAGCCGTAGTTAGGCCACCACTTCAAGAACTCTGTAGCACCGCCTACAT<br>ACCTCGCTCTGCTAATCCTGTTACCAGTGGCTGCTGCCAGTGGCGATAAGTCGTGTCTTACCGGG<br>TTGGACTCAAGACGATAGTTACCGGATAAGGCGCAGCGGTCGGGCTGAACGGGGGGTTCGTGCA<br>CACAGCCCAGCTTGGAGCGAACGACCTACACCGAACTGAGATACCTACAGCGTGAGCTATGAGA<br>AAGCGCCACGCTTCCCGAAGGGAGAAAGGCGGACAGGTATCCGGTAAGCGGCAGGGTCGGAAC<br>AGGAGAGCGCACGAGGGAGCTTCCAGGGGGAAACGCCTGGTATCTTTATAGTCCTGTCGGGTTT<br>CGCCACCTCTGACTTGAGCGTCGATTTTTGTGATGCTCGTCAGGGGGGCGGAGCCTATGGAAAA<br>ACGCCAGCAACGCGGCCTTTTTACGGTTCCTGGGCTTTTGCTGGCCTTTTGCTCACATGTTCTTTC<br>CTGCGTTATCCCCTGATTCTGTGGATAACCGTATTACCGCCTTTGAGTGAGCTGATACCGCTCGC<br>CGCAGCCGAACGACCGAGCGCAGCGAGTCAGTGAGCGAGGAAGCGGAAG |
| 5F9-anti-CD47-scFv polypeptide sequence SEQ ID NO: 996 | QVQLVQSGAEVKKPGASVKVSCKASGYTFTNYNMHWVRQAPGQRLEWMGTIYPGNDDTSY<br>NQKFKDRVTITADTSASTAYMELSSLRSEDTAVYYCARGGYRAMDYWGQGTLVTVSSGGG<br>GSGGGGSGGGGSDIVMTQSPLSLPVTPGEPASISCRSSQSIVYSNGNTYLGWYLQKPGQS<br>PQLLIYKVSNRFSGVPDRFSGSGSGTDFTLKISRVEAEDVGVYYCFQGSHVPYTFGQGTK<br>LEIK |

In some embodiments, the Anti-CD47 scFv sequences is at least about 80%, at least about 85%, at least about 90%, at least about 95%, or at least about 99% homologous to the sequence of SEQ ID NO: 993, SEQ ID NO: 994, SEQ ID NO: 995, and/or SEQ ID NO: 996.

5'-tetramethylbenzidine (TMB). Signal intensities were measured using an ELISA reader at 450 nm. Results are shown in Table 122 and indicate that the antiCD47-scFv expressed by the genetically engineered bacteria can bind to humanCD47 specifically.

TABLE 122

ELISA Binding Assay

| Strain | Coating | Primary antibody | Secondary antibody | OD450 |
|---|---|---|---|---|
| SYN2936 (pUC-Ptet-B6H12scFv-V5-HIS) | PBS | B6H12-scFv extracts | Anti-V5-HRP | 0.047 |
| SYN2936 (pUC-Ptet-B6H12scFv-V5-HIS) | IgG | B6H12-scFv extracts | Anti-V5-HRP | 0.064 |
| SYN2936 (pUC-Ptet-B6H12scFv-V5-HIS) | hCD47 | B6H12-scFv extracts | Anti-V5-HRP | 1.587 |
| SYN2936 (pUC-Ptet-B6H12scFv-V5-HIS) | mCD47 | B6H12-scFv extracts | Anti-V5-HRP | 0.053 |
| SYN2937 (pUC-Ptet-5F9scFv-V5-HIS) | PBS | 5F9-scFv extracts | Anti-V5-HRP | 0.048 |
| SYN2937 (pUC-Ptet-5F9scFv-V5-HIS) | IgG | 5F9-scFv extracts | Anti-V5-HRP | 0.057 |
| SYN2937 (pUC-Ptet-5F9scFv-V5-HIS) | hCD47 | 5F9-scFv extracts | Anti-V5-HRP | 1.838 |
| SYN2937 (pUC-Ptet-5F9scFv-V5-HIS) | mCD47 | 5F9-scFv extracts | Anti-V5-HRP | 0.053 |

*E. coli* DH5a comprising pUC-ptet-B6H12antihCD47scFv-V5-HIS or pUC-ptet-5F9antihCD47scFv-V5-HIS were grown overnight in LB medium. Cultures were diluted 1:100 in LB and grown shaking (200 rpm) to an optical density of 0.8 at which time cultures were cooled down to room temperature and anhydrous tetracycline (ATC) was added to cultures at a concentration of 100 ng/mL to induce expression of ptet-scFv for 18 hours and then bacteria were pelleted, washed in PBS, and harvested, resuspended in 2 mL PBS buffer and lysed by sonication on ice. Insoluble debris is spun down twice for 15 min at 12,000 rpm at 4° C.

To determine whether the anti CD47 single-chain antibody expressed in *E. coli* DH5a functionally binds to the target protein, an ELISA assay was performed. Plates were absorbed overnight at 4° C. with 100 µL of 2 µg/mL per well of target proteins (humanCD47, mouseCD47, IgG and PBS, from Rndsystems). Wells were blocked with 2% BSA in PBS/0.1% Tween-20 for 2 hours at room temperature. After three washes, wells were incubated with bacterial extracts for 1 hour at room temperature. Wells were washed 4 times with PBST (PBS/0.1% Tween-20) and incubated with a HRP-conjugated anti-V5 antibody (Biolegend) in blocking solution for 40 min. Following incubation, wells were-washed 4 times with PBST and then stained using a 3,3',5,

Example 58. Tumor Pharmacokinetics for *E coli* Nissle Over a 7 Day Period

Tumor pharmacokinetics of streptomycin resistant Nissle were determined using a CT26 tumor model.

CT26 cells obtained from ATCC were cultured according to guidelines provided. Approximately ~1e6 cells/mouse in PBS were implanted subcutaneously into the right flank of each animal (BalbC/J (female, 8 weeks)), and tumor growth was monitored for approximately 10 days. When the tumors reached about ~100-150 mm3, animals were randomized into groups for dosing.

For intratumoral injection, bacterial strain (Streptomycin resistant Nissle (SYN094) was grown in LB broth until reaching an absorbance at 600 nm (A600 nm) of 0.4 (corresponding to 2×108 colony-forming units (CFU)/mL) and washed twice in PBS. The suspension was diluted in PBS or saline so that 100 microL can be injected at the appropriate doses intratumorally into tumor-bearing mice.

Approximately 10 days after CT 26 implantation, bacteria were suspended in 0.1 ml of PBS and mice were injected (1e7 and 1e8 cells/dose) with 100 ul intratumorally as follows: Group 1-SYN94 IT 10e7, 1.5 h (n=3); Group 2-SYN94 IT 10e8, 1.5hh (n=3); Group 3-SYN94 IT 10e7, 4 h (n=3); Group 4-SYN94 IT 10e8, 4 h (n=3); Group 5-SYN94 IT 10e7, 24 h (n=3); Group 6-SYN94 IT 10e8, 24 h (n=3); Group 7-SYN94 IT 10e7, 72 h (n=3); Group 8-SYN94 IT 10e8, 72 h (n=3); Group 9-SYN94 IT 10e7, 7d (n=3); Group 10-SYN94 IT 10e8, 7d (n=3).

On day 1, animals were dosed intratumorally (IT) with 100 ul SYN94 at the two doses. At 1.5 and 4 h post dose, tumor, liver, lung and DLN tissue and blood was harvested. On day 2 (24 h post dose), on day 4 (72 hours post dose), and on day 7 (7d post dose) tissues and blood was harvested in the same manner as on Day 1.

In order to determine the CFU of bacteria in each sample, the blood samples were serially diluted, and the tissue samples were homogenized in PBS and serially diluted. Dilutions were plated onto LB plates containing streptomycin. The plates were incubated at 37° C. overnight, and colonies were counted. As seen in FIG. 38, bacterial counts in the tumor tissue were similar at both doses.

Example 59. Tumor Pharmacokinetics for *E. coli* Nissle and *E. coli* Nissle DOM Mutants Tumor pharmacokinetics of streptomycin resistant Nissle and a Nissle DOM mutant (Nissle delta PAL::CmR) were compared in a CT26 tumor model.

CT26 cells obtained from ATCC were cultured according to guidelines provided. Approximately ~1e6 cells/mouse in PBS were implanted subcutaneously into the right flank of each animal (BalbC/J (female, 8 weeks)), and tumor growth was monitored for approximately 10 days. When the tumors reached about ~100-150 mm3, animals were randomized into groups for dosing.

For intratumoral injection, bacterial strains (Streptomycin resistant Nissle (SYN094) and SYN1557 (Nissle delta PAL::CmR) were grown in LB broth until reaching an absorbance at 600 nm (A600 nm) of 0.4 (corresponding to 2×108 colony-forming units (CFU)/mL) and washed twice in PBS. The suspension was diluted in PBS or saline so that 100 microL can be injected at the appropriate doses intratumorally into tumor-bearing mice.

Approximately 10 days after CT 26 implantation, bacteria were suspended in 0.1 ml of PBS and mice were injected (1e7 cells/dose) with 100 ul intratumorally as follows: Group 1-SYN1557, 1.5 h (n=3); Group 2-SYN94, 1.5 h (n=3); Group 3-SYN1557, 4 h (n=3); Group 4-SYN94, 4 h (n=3); Group 5-SYN1557, 24 h (n=3); Group 6-SYN94, 24 h (n=3); Group 7-SYN1557, 72 h (n=3); Group 8-SYN94, 72 h (n=3); Group 9-SYN1557, 7d (n=3); Group 10-SYN94, 7d (n=3).

On day 1, animals were dosed intratumorally (IT) with 100 ul SYN94 or SYN1557 (1e7 cells/dose). At 1.5 and 4 h post dose, tumor tissue and blood was harvested. For blood collection 20 ul was used for bacterial plating-process, and the rest of sample was used for serum. On day 2 (24 h post dose), on day 4 (72 hours post dose), and on day 7 (7d post dose) tumor tissue and blood was harvested the same as on Day 1.

In order to determine the CFU of bacteria in each sample, the blood samples were serially diluted, and the tumor sample was homogenized in PBS and serially diluted. Dilutions were plated onto LB plates containing streptomycin or chloramphenicol. The plates were incubated at 37° C. overnight, and colonies were counted. As seen in FIGS. 37A and 37B, bacterial counts in the tumor tissue were similar in both strains, and no bacteria were detected in the blood. These results indicate that both the wild type and the DOM mutant Nissle can survive in the tumor environment.

Example 60. Tumoral PK of SYN94 Administered IT in the CT26 Syngeneic Tumor Model at 48 h Tumoral PK, levels of bacteria in various tissues and cytokine levels in these tissues were assessed post IT dosing.

CT26 cells obtained from ATCC were cultured according to guidelines provided. Approximately ~1e6 cells/mouse in PBS were implanted subcutaneously into the right flank of each animal (BalbC/J (female, 8 weeks)), and tumor growth was monitored for approximately 10 days. When the tumors reached about ~100-150 mm3, animals were randomized into groups for dosing.

For intratumoral injection, bacterial strain (Streptomycin resistant Nissle (SYN094) was grown in LB broth until reaching an absorbance at 600 nm (A600 nm) of 0.4 (corresponding to 2×108 colony-forming units (CFU)/mL) and washed twice in PBS. The suspension was diluted in PBS or saline so that 100 microL can be injected at the appropriate doses intratumorally into tumor-bearing mice.

Approximately 10 days after CT 26 implantation, bacteria were suspended in 0.1 ml of PBS and mice were injected (1e7 cells/dose) with 100 ul intratumorally as follows: Group 1-SYN94 IT, 48 h (n=6); Group 2-Saline Control IT, 48 h (n=3); Group 3-Naïve Control, 48 h (n=3). On day 1, Group animals were dosed intratumorally (IT) with 100 ul SYN94 at the three doses, Group 2 was dosed with saline, and Group 3 (co-housed) was kept untreated. At 48 hours post dose, tumor, liver, lung and DLN, and brain tissue and placed in pre-weighed tubes on ice. Blood was collected by cardiac puncture.

For tissue, 0.5 ml sterile PBS was added to each tube and samples were homogenized. 100 ul of each homogenate was removed and plated in serial dilutions on LB(+)strep plates. For blood, 20 ul was plated in serial dilutions on LB(+)strep plates. The remainder of the blood was allowed to clot in microfuge tube for 15-30 min at room temperature. Tubes were centrifuged for 10 min at 2000 rpm, 4 C, and serum was transferred to fresh microfuge tubes and stored at -80 C for cytokine analysis. As seen in FIG. 39A and FIG. 39B, bacteria were predominantly present in the tumor and absent in other tissues tested. TNFa levels measured were similar in all serum, tumor and liver between SYN94, Saline treated and naïve groups. As seen in FIG. 40, TNFalpha levels are negligible relative to TNFalpha levels measured at 1.5 hours when Nissle is administered at 1e8 via IV. However, even with IV administration, TNFalpha levels drop off to undetectable levels at 4 hours. Similar low levels of TNFa are detected at a 1e6 IV dose of SYN94.

Example 61. Tumor Pharmacokinetics for *E coli* Nissle Over a 7 Day Period

Cytokine response in vivo to intratumoral administration of streptomycin resistant Nissle was assessed using a CT26 tumor model.

CT26 cells obtained from ATCC were cultured according to guidelines provided. Approximately ~1e6 cells/mouse in PBS were implanted subcutaneously into the right flank of each animal (BalbC/J (female, 8 weeks)), and tumor growth was monitored for approximately 10 days. When the tumors reached about ~100-150 mm3, animals were randomized into groups for dosing.

For intratumoral injection, bacterial strain (Streptomycin resistant Nissle (SYN094) was grown in LB broth until reaching an absorbance at 600 nm (A600 nm) of 0.4 (corresponding to 2×108 colony-forming units (CFU)/mL) and washed twice in PBS. The suspension was diluted in PBS or saline so that 100 microL can be injected at the appropriate doses intratumorally into tumor-bearing mice.

Approximately 10 days after CT 26 implantation, bacteria were suspended in 0.1 ml of PBS and mice were injected (either 1e6 (Group1) or 1e7 cells/dose (Group 2)) with 100 ul intratumorally.

On day 1, animals were dosed intratumorally (IT) with 100 ul SYN94 at the two doses. At 1.5 and 4 h post dose, tumor, liver, lung and DLN and pancreatic tissue was harvested and blood was collected by cardiac puncture from three animals. On day 2 (24 h post dose), on day 4 (72 hours post dose), on day 8 (7d post dose), and on day 15 (15d post dose) tissues and blood were harvested in the same manner as on Day 1.

FIG. 41 shows TNFalpha (FIG. 41A), IL-6 (FIG. 41B), and IL-1beta (FIG. 41C) levels measured in serum and in the tumor over the time course post SYN94 intratumoral administration in the mouse CT-24 model at the indicated doses. Results indicate that a cytokine response is elicited in the tumor at the higher dose but not in the serum. The lower dose does not elicit a substantial cytokine response.

Example 62. Assessment of In Vitro and In Vivo Activity of Biosafety System Containing Strain The activity of the following strains is tested:

SYN-1001 comprises a construct shown in FIG. 76C knocked into the dapA locus on the bacterial chromosome (low copy RBS; dapA::constitutive proml (BBA_J26100)-Pi(R6K)-constitutive promoter 2(P1)-Kis antitoxin). The strain further comprises a plasmid shown in FIG. 76A, except that the bla gene is replaced with the construct of SEQ ID NO: 959 (human TNFa construct with a N terminal PhoA secretion tag). In some embodiments, SEQ ID NO: 959 is operably linked to a FNR promoter and induced under low oxygen conditions. In some embodiments, SEQ ID NO: 959 is linked to a constitutive promoter.

SYN-1002 comprises a construct shown in FIG. 76C knocked into the dapA locus on the bacterial chromosome (low copy RBS; dapA::constitutive proml (BBA_J26100)-Pi(R6K)-constitutive promoter 2(P1)-Kis antitoxin). The strain further comprises a plasmid shown in FIG. 76A, except that the bla gene is replaced with the construct of SEQ ID NO: 960 (human IFNg construct with a N terminal PhoA secretion tag). In some embodiments, SEQ ID NO: 960 is operably linked to a FNR promoter and induced under low oxygen conditions. In some embodiments, SEQ ID NO: 960 is linked to a constitutive promoter.

SYN-1003 comprises a construct shown in FIG. 76D knocked into the dapA locus on the bacterial chromosome (medium copy RBS; dapA::constitutive proml (BBA_J26100)-Pi(R6K)-constitutive promoter 2(P1)-Kis antitoxin). The strain further comprises a plasmid shown in FIG. 76A, except that the bla gene is replaced with SEQ ID NO: SEQ ID NO: 959 (human TNFa construct with a N terminal PhoA secretion tag). In some embodiments, SEQ ID NO: 959 is operably linked to a FNR promoter and induced under low oxygen conditions. In some embodiments, SEQ ID NO: 959 is linked to a constitutive promoter.

SYN-1004 comprises a construct shown in FIG. 76D knocked into the dapA locus on the bacterial chromosome (medium copy RBS; dapA::constitutive proml (BBA_J26100)-Pi(R6K)-constitutive promoter 2(P1)-Kis antitoxin). The strain further comprises a plasmid shown in FIG. 76A, except that the bla gene is replaced with SEQ ID NO: 960 (human IFNg construct with a N terminal PhoA secretion tag). In some embodiments, SEQ ID NO: 960 is operably linked to a FNR promoter and induced under low oxygen conditions. In some embodiments, SEQ ID NO: 960 is linked to a constitutive promoter.

SYN-1005 comprises a construct shown in FIG. 76C knocked into the thyA locus on the bacterial chromosome (low copy RBS; thyA::constitutive proml (BBA_J26100)-Pi(R6K)-constitutive promoter 2(P1)-Kis antitoxin). The strain further comprises a plasmid shown in FIG. 76B, except that the bla gene is replaced with the construct of SEQ ID NO: 959 (human TNFa construct with a N terminal PhoA secretion tag). In some embodiments, SEQ ID NO: 959 is operably linked to a FNR promoter and induced under low oxygen conditions. In some embodiments, SEQ ID NO: 959 is linked to a constitutive promoter.

SYN-1006 comprises a construct shown in FIG. 76C knocked into the thyA locus on the bacterial chromosome (low copy RBS; thyA::constitutive proml (BBA_J26100)-Pi(R6K)-constitutive promoter 2(P1)-Kis antitoxin). The strain further comprises a plasmid shown in FIG. 76B, except that the bla gene is replaced with the construct of SEQ ID NO: 960 (human IFNg construct with a N terminal PhoA secretion tag). In some embodiments, SEQ ID NO: 960 is operably linked to a FNR promoter and induced under low oxygen conditions. In some embodiments, SEQ ID NO: 960 is linked to a constitutive promoter.

SYN-1007 comprises a construct shown in FIG. 76D knocked into the thyA locus on the bacterial chromosome (medium copy RBS; thyA::constitutive proml (BBA_J26100)-Pi(R6K)-constitutive promoter 2(P1)-Kis antitoxin). The strain further comprises a plasmid shown in FIG. 76B, except that the bla gene is replaced with SEQ ID NO: 959 (human TNFa construct with a N terminal PhoA secretion tag). In some embodiments, SEQ ID NO: 959 is operably linked to a FNR promoter and induced under low oxygen conditions. In some embodiments, SEQ ID NO: 959 is linked to a constitutive promoter.

SYN-1008 a construct shown in FIG. 76D knocked into the thyA locus on the bacterial chromosome (medium copy RBS; thyA::constitutive proml (BBA_J26100)-Pi(R6K)-constitutive promoter 2(P1)-Kis antitoxin). The strain further comprises a plasmid shown in FIG. 76B, except that the bla gene is replaced with SEQ ID NO: 960 (human IFNg construct with a N terminal PhoA secretion tag. In some embodiments, SEQ ID NO: 960 is operably linked to a FNR promoter and induced under low oxygen conditions. In some embodiments, SEQ ID NO: 960 is linked to a constitutive promoter.

TABLE 123

Biosafety System Constructs and Sequence Components

| Description | Sequence | SEQ ID NO |
|---|---|---|
| Biosafety Plasmid System Component - dapA Biosafety Plasmid System Vector sequences, comprising dapA, Kid Toxin and R6K minimal ori, and promoter elements driving expression of these components, as shown in FIG. 76A | ACTCTTCCTTTTTCAATATTATTGAAGCATTTATCAG GGTTATTGTCTCATGAGCGGATACATATTTGAATGT ATTTAGAAAAATAAACAAATAGGGGAATTAAAAAA AAGCCCGCTCATTAGGCGGGCTACTACCTAGGCCG CGGCCGCGCGAATTCGAGCTCGGTACCCGGGGATC CTCTAGAGTCGACCTGCAGGCATGCAAGCTTGCGG CCGCGTCGTGACTGGGAAAACCCTGGCGACTAGTC TTGGACTCCTGTTGATAGATCCAGTAATGACCTCAG AACTCCATCTGGATTTGTTCAGAACGCTCGGTTGCC GCCGGGCGTTTTTTATTGGTGAGAATCCAGGGGTCC CCAATAATTACGATTTAAATCACAGCAAACACCAC GTCGGCCCTATCAGCTGCGTGCTTTCTATGAGTCGT TGCTGCATAACTTGACAATTAACATCCGGCTCGTAG GGTTTGTGGAGGGCCCAAGTTCACTTAAAAAGGAG ATCAACAATGAAAGCAATTTTCGTACTGAAACATCT TAATCATGCTGGGGAGGGTTTCTAATGTTCACGGGA AGTATTGTCGCGATTGTTACTCCGATGGATGAAAAA GGTAATGTCTGTCGGGCTAGCTTGAAAAAACTGATT GATTATCATGTCGCCAGCGGTACTTCGGCGATCGTT TCTGTTGGCACCACTGGCGAGTCCGCTACCTTAAAT CATGACGAACATGCTGATGTGGTGATGATGACGCT GGATCTGGCTGATGGGCGCATTCCGGTAATTGCCGG GACCGGCGCTAACGCTACTGCGGAAGCCATTAGCC TGACGCAGCGCTTCAATGACAGTGGTATCGTCGGCT GCCTGACGGTAACCCCTTACTACAATCGTCCGTCGC AAGAAGGTTTGTATCAGCATTTCAAAGCCATCGCTG AGCATACTGACCTGCCGCAAATTCTGTATAATGTGC CGTCCCGTACTGGCTGCGATCTGCTCCCGGAAACGG TGGGCCGTCTGGCGAAAGTAAAAAATATTATCGGA ATCAAAGAGGCAACAGGGAACTTAACGCGTGTAAA CCAGATCAAAGAGCTGGTTTCAGATGATTTTGTTCT GCTGAGCGGCGATGATGCGAGCGCGCTGGACTTCA TGCAATTGGGCGGTCATGGGGTTATTTCCGTTACGG CTAACGTCGCAGCGCGTGTATATGGCCCAGATGTGC AAACTGGCAGCAGAAGGGCATTTTGCCGAGGCACG CGTTATTAATCAGCGTCTGATGCCATTACACAACAA ACTATTTGTCGAACCCAATCCAATCCCGGTGAAATG GGCATGTAAGGAACTGGGTCTTGTGGCGACCGATA CGCTGCGCCTGCCAATGACACCAATCACCGACAGT GGCCGTGAGACGGTCAGAGCGGCGCTTAAACATGC CGGTTTGCTGTAAGACTTTTGTCAGGTTCCTACTGT GACGACTACCACCGATAGACTGGAGTGTTGCTGCG AAAAAACCCCGCCGAAGCGGGGTTTTTTGCGAGAA GTCACCACGATTGTGCTTTACACGGAGTAGTCGGCA GTTCCTTAAGTCAGAATAGTGGACAGGCGGCCAAG AACTTCGTTCATGATAGTCTCCGGAACCCGTTCGAG TCGTTTTCCGCCCCGTGCTTTCATATCAATTGTCCGG GGTTGATCGCAACGTACAACACCTGTGGTACGTATG CCAACACCATCCAACGACACCGCAAAGCCGGCAGT GCGGGCAAAATTGCCTCCGCTGGTTACGGGCACAA CAACAGGCAGGCGGGTCACGCGATTAAAGGCCGCC GGTGTGACAATCAGCACCGGCCGCGTTCCCTGCTGC TCATGACCTGCGGTAGGATCAAGCGAGACAAGCCA GATTTCCCCTCTTTCCATCTAGTATAACTATTGTTTC TCTAGTAACATTTATTGTACAACACGAGCCCATTTT TGTCAAATAAATTTTAAATTATATCAACGTTAATAA GACGTTGTCAATAAAATTATTTTGACAAAATTGGCC GGCCGGCGCGCCGATCTGAAGATCAGCAGTTCAAC CTGTTGATAGTACGTACTAAGCTCTCATGTTTCACG TACTAAGCTCTCATGTTTAACGTACTAAGCTCTCAT GTTTAACGAACTAAACCCTCATGGCTAACGTACTAA GCTCTCATGGCTAACGTACTAAGCTCTCATGTTTCA CGTACTAAGCTCTCATGTTTGAACAATAAAATTAAT ATAAATCAGCAACTTAAATAGCCTCTAAGGTTTTAA GTTTTATAAGAAAAAAAAGAATATATAAGGCTTTT AAAGCCTTTAAGGTTTAACGGTTGTGGACAACAAG CCAGGGATGTAACGCACTGAGAAGCCCTTAGAGCC TCTCAAAGCAATTTTGAGTGACACAGGAACACTTA ACGGCTGACATGGGGCGCGCCCAGCTGTCTAGGGC GGCGGATTTGTCCTACTCAGGAGAGCGTTCACCGAC AAACAACAGATAAAACGAAAGGCCCAGTCTTTCGA CTGAGCCTTTCGTTTTATTTGATGCCT | 997 |

TABLE 123-continued

Biosafety System Constructs and Sequence Components

| Description | Sequence | SEQ ID NO |
|---|---|---|
| Biosafety Plasmid System Component - ThyA Biosafety Plasmid System Vector sequences, comprising ThyA, Kid Toxin and R6K minimal ori, and promoter elements driving expression of these components, as shown in FIG. 76B | ACTCTTCCTTTTTCAATATTATTGAAGCATTTATCAG GGTTATTGTCTCATGAGCGGATACATATTTGAATGT ATTTAGAAAAATAAACAAATAGGGGAATTAAAAAA AAGCCCGCTCATTAGGCGGGCTACTACCTAGGCCG CGGCCGCGCGAATTCGAGCTCGGTACCCGGGGATC CTCTAGAGTCGACCTGCAGGCATGCAAGCTTGCGG CCGCGTCGTGACTGGGAAAACCCTGGCGACTAGTC TTGGACTCCTGTTGATAGATCCAGTAATGACCTCAG AACTCCATCTGGATTTGTTCAGAACGCTCGGTTGCC GCCGGGCGTTTTTTATTGGTGAGAATCCAGGGGTCC CCAATAATTACGATTTAAATCACAGCAAACACCAC GTCGGCCCTATCAGCTGCGTGCTTTCTATGAGTCGT TGCTGCATAACTTGACAATTAATCATCCGGCTCGTA GGGTTTGTGGAGGGCCCAAGTTCACTTAAAAAGGA GATCAACAATGAAAGCAATTTTCGTACTGAAACAT CTTAATCATGCTGGGGAGGGTTTCTAATGAAACAGT ATTTAGAACTGATGCAAAAAGTGCTCGACGAAGGC ACACAGAAAAACGACCGTACCGGAACCGGAACGCT TTCCATTTTTGGTCATCAGATGCGTTTTAACCTGCA AGATGGATTCCCGCTGGTGACAACTAAACGTTGCC ACCTGCGTTCCATCATCCATGAACTGCTGTGGTTTC TTCAGGGCGACACTAACATTGCTTATCTACACGAAA ACAATGTCACCATCTGGGACGAATGGGCCGATGAA AACGGCGACCTCGGGCCAGTGTATGGTAAACAGTG GCGTGCCTGGCCAACGCCAGATGGTCGTCATATTGA CCAGATCACTACGGTACTGAACCAGCTGAAAAACG ACCCGGATTCGCGCCGCATTATTGTTTCAGCGTGGA ACGTAGGCGAACTGGATAAAATGGCGCTGGCACCG TGCCATGCATTCTTCCAGTTCTATGTGGCAGACGGC AAACTCTCTTGCCAGCTTTATCAGCGCTCCTGTGAC GTCTTCCTCGGCCTGCCGTTCAACATTGCCAGCTAC GCGTTATTGGTGCATATGATGGCGCAGCAGTGCGAT CTGGAAGTGGGTGATTTTGTCTGGACCGGTGGCGAC ACGCATCTGTACAGCAACCATATGGATCAAACTCAT CTGCAATTAAGCCGCGAACCGCGTCCGCTGCCGAA GTTGATTATCAAACGTAAACCCGAATCCATCTTCGA CTACCGTTTCGAAGACTTTGAGATTGAAGGCTACGA TCCGCATCCGGGCATTAAAGCGCCGGTGGCTATCTA AGACTTTTGTCAGGTTCCTACTGTGACGACTACCAC CGATAGACTGGAGTGTTGCTGCGAAAAAACCCCGC CGAAGCGGGGTTTTTTGCGAGAAGTCACCACGATT GTGCTTTACACGGAGTAGTCGGCAGTTCCTTAAGTC AGAATAGTGGACAGGCGGCCAAGAACTTCGTTCAT GATAGTCTCCGGAACCCGTTCGAGTCGTTTTCCGCC CCGTGCTTTCATATCAATTGTCCGGGGTTGATCGCA ACGTACAACACCTGTGGTACGTATGCCAACACCATC CAACGACACCGCAAAGCCGGCAGTGCGGGCAAAAT TGCCTCCGCTGGTTACGGGCACAACAACAGGCAGG CGGGTCACGCGATTAAAGGCCGCCGGTGTGACAAT CAGCACCGGCCGCGTTCCCTGCTGCTCATGACCTGC GGTAGGATCAAGCGAGACAAGCCAGATTTCCCCTC TTTCCATCTAGTATAACTATTGTTTCTCTAGTAACAT TTATTGTACAACACGAGCCCATTTTTGTCAAATAAA TTTTAAATTATATCAACGTTAATAAGACGTTGTCAA TAAAATTATTTTGACAAAATTGGCCGGCCGGCGCGC CGATCTGAAGATCAGCAGTTCAACCTGTTGATAGTA CGTACTAAGCTCTCATGTTTCACGTACTAAGCTCTC ATGTTTAACGTACTAAGCTCTCATGTTTAACGAACT AAACCCTCATGGCTAACGTACTAAGCTCTCATGGCT AACGTACTAAGCTCTCATGTTTCACGTACTAAGCTC TCATGTTTGAACAATAAAATTAATATAAATCAGCAA CTTAAATAGCCTCTAAGGTTTTAAGTTTTATAAGAA AAAAAGAATATATAAGGCTTTTAAAGCCTTTAAG GTTTAACGGTTGTGGACAACAAGCCAGGGATGTAA CGCACTGAGAAGCCCTTAGAGCCTCTCAAAGCAAT TTTGAGTGACACAGGAACACTTAACGGCTGACATG GGGCGCGCCCAGCTGTCTAGGGCGGCGGATTTGTC CTACTCAGGAGAGCGTTCACCGACAAACAACAGAT AAAACGAAAGGCCCAGTCTTTCGACTGAGCCTTTCG TTTTATTTGATGCCT | 998 |
| Kid toxin (reverse orientation) | TTAAGTCAGAATAGTGGACAGGCGGCCAAGAACTT CGTTCATGATAGTCTCCGGAACCCGTTCGAGTCGTT TTCCGCCCCGTGCTTTCATATCAATTGTCCGGGGTT GATCGCAACGTACAACACCTGTGGTACGTATGCCA | 999 |

TABLE 123-continued

Biosafety System Constructs and Sequence Components

| Description | Sequence | SEQ ID NO |
|---|---|---|
| | ACACCATCCAACGACACCGCAAAGCCGGCAGTGCG GGCAAAATTGCCTCCGCTGGTTACGGGCACAACAA CAGGCAGGCGGGTCACGCGATTAAAGGCCGCCGGT GTGACAATCAGCACCGGCCGCGTTCCCTGCTGCTCA TGACCTGCGGTAGGATCAAGCGAGACAAGCCAGAT TTCCCCTCTTTCCAT | |
| dapA | ATGTTCACGGGAAGTATTGTCGCGATTGTTACTCCG ATGGATGAAAAAGGTAATGTCTGTCGGGCTAGCTT GAAAAAACTGATTGATTATCATGTCGCCAGCGGTA CTTCGGCGATCGTTTCTGTTGGCACCACTGGCGAGT CCGCTACCTTAAATCATGACGAACATGCTGATGTGG TGATGATGACGCTGGATCTGGCTGATGGGCGCATTC CGGTAATTGCCGGGACCGGCGCTAACGCTACTGCG GAAGCCATTAGCCTGACGCAGCGCTTCAATGACAG TGGTATCGTCGGCTGCCTGACGGTAACCCCTTACTA CAATCGTCCGTCGCAAGAAGGTTTGTATCAGCATTT CAAAGCCATCGCTGAGCATACTGACCTGCCGCAAA TTCTGTATAATGTGCCGTCCCGTACTGGCTGCGATC TGCTCCCGGAAACGGTGGGCCGTCTGGCGAAAGTA AAAAATATTATCGGAATCAAAGAGGCAACAGGGAA CTTAACGCGTGTAAACCAGATCAAAGAGCTGGTTTC AGATGATTTTGTTCTGCTGAGCGGCGATGATGCGAG CGCGCTGGACTTCATGCAATTGGGCGGTCATGGGGT TATTTCCGTTACGGCTAACGTCGCAGCGCGTGATAT GGCCCAGATGTGCAAACTGGCAGCAGAAGGGCATT TTGCCGAGGCACGCGTTATTAATCAGCGTCTGATGC CATTACACAACAAACTATTTGTCGAACCCAATCCAA TCCCGGTGAAATGGGCATGTAAGGAACTGGGTCTT GTGGCGACCGATACGCTGCGCCTGCCAATGACACC AATCACCGACAGTGGCCGTGAGACGGTCAGAGCGG CGCTTAAACATGCCGGTTTGCTGTAA | 1000 |
| thyA | ATGAAACAGTATTTAGAACTGATGCAAAAAGTGCT CGACGAAGGCACACAGAAAAACGACCGTACCGGA ACCGGAACGCTTTCCATTTTTGGTCATCAGATGCGT TTTAACCTGCAAGATGGATTCCCGCTGGTGACAACT AAACGTTGCCACCTGCGTTCCATCATCCATGAACTG CTGTGGTTTCTTCAGGGCGACACTAACATTGCTTAT CTACACGAAAACAATGTCACCATCTGGGACGAATG GGCCGATGAAAACGGCGACCTCGGGCCAGTGTATG GTAAACAGTGGCGTGCCTGGCCAACGCCAGATGGT CGTCATATTGACCAGATCACTACGGTACTGAACCAG CTGAAAAACGACCCGGATTCGCGCCGCATTATTGTT TCAGCGTGGAACGTAGGCGAACTGGATAAAATGGC GCTGGCACCGTGCCATGCATTCTTCCAGTTCTATGT GGCAGACGGCAAACTCTCTTGCCAGCTTTATCAGCG CTCCTGTGACGTCTTCCTCGGCCTGCCGTTCAACAT TGCCAGCTACGCGTTATTGGTGCATATGATGGCGCA GCAGTGCGATCTGGAAGTGGGTGATTTTGTCTGGAC CGGTGGCGACACGCATCTGTACAGCAACCATATGG ATCAAACTCATCTGCAATTAAGCCGCGAACCGCGTC CGCTGCCGAAGTTGATTATCAAACGTAAACCCGAA TCCATCTTCGACTACCGTTTCGAAGACTTTGAGATT GAAGGCTACGATCCGCATCCGGGCATTAAAGCGCC GGTGGCTATCTAA | 1001 |
| Kid toxin polypeptide | MERGEIWLVSLDPTAGHEQQGTRPVLIVTPAAFNRVT RLPVVVPVTSGGNFARTAGFAVSLDGVGIRTTGVVRC DQPRTIDMKARGGKRLERVPETIMNEVLGRLSTILT* | 1002 |
| dapA polypeptide | MFTGSIVAIVTPMDEKGNVCRASLKKLIDYHVASGTS AIVSVGTTGESATLNHDEHADVVMMTLDLADGRIPVI AGTGANATAEAISLTQRFNDSGIVGCLTVTPYYNRPS QEGLYQHFKAIAEHTDLPQILYNVPSRTGCDLLPETVG RLAKVKNIIGIKEATGNLTRVNQIKELVSDDFVLLSGD DASALDFMQLGGHGVISVTANVAARDMAQMCKLAA EGHFAEARVINQRLMPLHNKLFVEPNPIPVKWACKEL GLVATDTLRLPMTPITDSGRETVRAALKHAGLL | 1003 |

TABLE 123-continued

Biosafety System Constructs and Sequence Components

| Description | Sequence | SEQ ID NO |
|---|---|---|
| ThyA polypeptide | MKQYLELMQKVLDEGTQKNDRTGTGTLSIFGHQMRF NLQDGFPLVTTKRCHLRSIIHELLWFLQGDTNIAYLHE NNVTIWDEWADENGDLGPVYGKQWRAWPTPDGRHI DQITTVLNQLKNDPDSRRIIVSAWNVGELDKMALAPC HAFFQFYVADGKLSCQLYQRSCDVFLGLPFNIASYAL LVHMMAQQCDLEVGDFVWTGGDTHLYSNHMDQTH LQLSREPRPLPKLIIKRKPESIFDYRFEDFEIEGYDPHPG IKAPVAI* | 1004 |

TABLE 124

Chromosomally Inserted Biosafety System Constructs

| Description | Sequence | SEQ ID NO |
|---|---|---|
| Biosafety Chromosomal Construct - low copy Rep (Pi) and Kis antitoxin (as shown in FIG. 76C) | TTGACGGCTAGCTCAGTCCTAGGTACAGTGCTAGCGGAT CTGCTGGAACAGGTGGTGAGACTCAAGGTCATGATGGA CGTGAACAAAAAAACGAAAATTCGCCACCGAAACGAGC TAAATCACACCCTGGCTCAACTTCCTTTGCCCGCAAAGC GAGTGATGTATATGGCGCTTGCTCCCATTGATAGCAAAG AACCTCTTGAACGAGGGCGAGTTTTCAAAATTAGGGCTG AAGACCTTGCAGCGCTCGCCAAAATCACCCCATCGCTTG CTTATCGACAATTAAAAGAGGGTGGTAAATTACTTGGTG CCAGCAAAATTTCGCTAAGAGGGGATGATATCATTGCTT TAGCTAAAGAGCTTAACCTGCTCTTTACTGCTAAAAACT CCCCTGAAGAGTTAGACCTTAACATTATTGAGTGGATAG CTTATTCAAATGATGAAGGATACTTGTCTTTAAAATTCA CCAGAACCATAGAACCATATATCTCTAGCCTTATTGGGA AAAAAAATAAATTCACAACGCAATTGTTAACGGCAAGC TTACGCTTAAGTAGCCAGTATTCATCTTCTCTTTATCAAC TTATCAGGAAGCATTACTCTAATTTTAAGAAGAAAAATT ATTTTATTATTTCCGTTGATGAGTTAAAGGAAGAGTTAA TAGCTTATACTTTTGATAAAGATGGAAATATTGAGTACA AATACCCTGACTTTCCTATTTTTAAAAGGGATGTGTTAA ATAAAGCCATTGCTGAAATTAAAAAGAAAACAGAAATA TCGTTTGTTGGCTTCACTGTTCATGAAAAAGAAGGAAGA AAAATTAGTAAGCTGAAGTTCGAATTTGTCGTTGATGAA GATGAATTTTCTGGCGATAAAGATGATGAAGCTTTTTTT ATGAATTTATCTGAAGCTGATGCAGCTTTTCTCAAGGTA TTTGATGAAACCGTACCTCCCAAAAAAGCTAAGGGGTGA GGATCCCCAGGCATCAAATAAAACGAAAGGCTCAGTCG AAAGACTGGGCCTTTCGTTTTATCTGTTGTTTGTCGGTGA ACGCTCTCTACTAGAGTCACACTGGCTCACCTTCGGGTG GGCCTTTCTGCGTTTATACCCGGGAAAAAGAGTATTGAC TtaaagtctaacctataggTATAATGTGTGGAGACCAGAGGTAAGG AGGTAACAACCATGCGAGTGTTGAAGAAACATCTTAATC ATGCTAAGGAGGTTTTCTAATGCATACCACCCGACTGAA GAGGGTTGGCGGCTCAGTTATGCTGACCGTCCCACCGGC ACTGCTGAATGCGCTGTCTCTGGGCACAGATAATGAAGT TGGCATGGTCATTGATAATGGCCGGCTGATTGTTGAGCC GTACAGACGCCCGCAATATTCACTGGCTGAGCTACTGGC ACAGTGTGATCCGAATGCTGAAATATCAGCTGAAGAAC GAGAATGGCTGGATGCACCGGCGACTGGTCAGGAGGAA ATCTGA | 1005 |
| Biosafety Chromosomal Construct - medium copy Rep (Pi) and Kis antitoxin (as shown in FIG. 76D) | TTGACGGCTAGCTCAGTCCTAGGTACAGTGCTAGCGGAT CTTCCGGAAGACTAGGTGAGACTCAAGGTCATGATGGAC GTGAACAAAAAAACGAAAATTCGCCACCGAAACGAGCT AAATCACACCCTGGCTCAACTTCCTTTGCCCGCAAAGCG AGTGATGTATATGGCGCTTGCTCCCATTGATAGCAAAGA ACCTCTTGAACGAGGGCGAGTTTTCAAAATTAGGGCTGA AGACCTTGCAGCGCTCGCCAAAATCACCCCATCGCTTGC TTATCGACAATTAAAAGAGGGTGGTAAATTACTTGGTGC CAGCAAAATTTCGCTAAGAGGGGATGATATCATTGCTTT AGCTAAAGAGCTTAACCTGCTCTTTACTGCTAAAAACTC CCCTGAAGAGTTAGACCTTAACATTATTGAGTGGATAGC TTATTCAAATGATGAAGGATACTTGTCTTTAAAATTCAC CAGAACCATAGAACCATATATCTCTAGCCTTATTGGGAA AAAAAATAAATTCACAACGCAATTGTTAACGGCAAGCTT ACGCTTAAGTAGCCAGTATTCATCTTCTCTTTATCAACTT | 1006 |

TABLE 124-continued

Chromosomally Inserted Biosafety System Constructs

| Description | Sequence | SEQ ID NO |
|---|---|---|
| | ATCAGGAAGCATTACTCTAATTTTAAGAAGAAAAATTAT<br>TTTATTATTTCCGTTGATGAGTTAAAGGAAGAGTTAATA<br>GCTTATACTTTTGATAAAGATGGAAATATTGAGTACAAA<br>TACCCTGACTTTCCTATTTTTAAAAGGGATGTGTTAAATA<br>AAGCCATTGCTGAAATTAAAAAGAAAACAGAAATATCG<br>TTTGTTGGCTTCACTGTTCATGAAAAAGAAGGAAGAAAA<br>ATTAGTAAGCTGAAGTTCGAATTTGTCGTTGATGAAGAT<br>GAATTTTCTGGCGATAAAGATGATGAAGCTTTTTTTATG<br>AATTTATCTGAAGCTGATGCAGCTTTTCTCAAGGTATTTG<br>ATGAAACCGTACCTCCCAAAAAAGCTAAGGGGTGAGGA<br>TCTCCAGGCATCAAATAAAACGAAAGGCTCAGTCGAAA<br>GACTGGGCCTTTCGTTTTATCTGTTGTTTGTCGGTGAACG<br>CTCTCTACTAGAGTCACACTGGCTCACCTTCGGGTGGGC<br>CTTTCTGCGTTTATACCCGGGAAAAAGAGTATTGACTtaaa<br>gtctaacctataggTATAATGTGTGGAGACCAGAGGTAAGGAGG<br>TAACAACCATGCGAGTGTTGAAGAAACATCTTAATCATG<br>CTAAGGAGGTTTTCTAATGCATACCACCCGACTGAAGAG<br>GGTTGGCGGCTCAGTTATGCTGACCGTCCCACCGGCACT<br>GCTGAATGCGTGTCTCTGGGCACAGATAATGAAGTTGG<br>CATGGTCATTGATAATGGCCGGCTGATTGTTGAGCCGTA<br>CAGACGCCCGCAATATTCACTGGCTGAGCTACTGGCACA<br>GTGTGATCCGAATGCTGAAATATCAGCTGAAGAACGAG<br>AATGGCTGGATGCACCGGCGACTGGTCAGGAGGAAATC<br>TGA | |
| Rep (Pi) | TGAGACTCAAGGTCATGATGGACGTGAACAAAAAAACG<br>AAAATTCGCCACCGAAACGAGCTAAATCACACCCTGGCT<br>CAACTTCCTTTGCCCGCAAAGCGAGTGATGTATATGGCG<br>CTTGCTCCCATTGATAGCAAAGAACCTCTTGAACGAGGG<br>CGAGTTTTCAAAATTAGGGCTGAAGACCTTGCAGCGCTC<br>GCCAAAATCACCCCATCGCTTGCTTATCGACAATTAAAA<br>GAGGGTGGTAAATTACTTGGTGCCAGCAAAATTTCGCTA<br>AGAGGGGATGATATCATTGCTTTAGCTAAAGAGCTTAAC<br>CTGCTCTTTACTGCTAAAAACTCCCCTGAAGAGTTAGAC<br>CTTAACATTATTGAGTGGATAGCTTATTCAAATGATGAA<br>GGATACTTGTCTTTAAAATTCACCAGAACCATAGAACCA<br>TATATCTCTAGCCTTATTGGGAAAAAAAATAAATTCACA<br>ACGCAATTGTTAACGGCAAGCTTACGCTTAAGTAGCCAG<br>TATTCATCTTCTCTTTATCAACTTATCAGGAAGCATTACT<br>CTAATTTTAAGAAGAAAAATTATTTTATTATTTCCGTTGA<br>TGAGTTAAAGGAAGAGTTAATAGCTTATACTTTTGATAA<br>AGATGGAAATATTGAGTACAAATACCCTGACTTTCCTAT<br>TTTTAAAGGGATGTGTTAAATAAAGCCATTGCTGAAAT<br>TAAAAAGAAAACAGAAATATCGTTTGTTGGCTTCACTGT<br>TCATGAAAAAGAAGGAAGAAAAATTAGTAAGCTGAAGT<br>TCGAATTTGTCGTTGATGAAGATGAATTTTCTGGCGATA<br>AAGATGATGAAGCTTTTTTTATGAATTTATCTGAAGCTG<br>ATGCAGCTTTTCTCAAGGTATTTGATGAAACCGTACCTC<br>CCAAAAAAGCTAAGGGGTGA | 1007 |
| Kis antitoxin | CATACCACCCGACTGAAGAGGGTTGGCGGCTCAGTTATG<br>CTGACCGTCCCACCGGCACTGCTGAATGCGTGTCTCTG<br>GGCACAGATAATGAAGTTGGCATGGTCATTGATAATGGC<br>CGGCTGATTGTTGAGCCGTACAGACGCCCGCAATATTCA<br>CTGGCTGAGCTACTGGCACAGTGTGATCCGAATGCTGAA<br>ATATCAGCTGAAGAACGAGAATGGCTGGATGCACCGGC<br>GACTGGTCAGGAGGAAATCTGA | 1008 |
| RBS (low copy) | GCTGGAACAGGTGG | 1009 |
| RBS (medium copy) | TCCGGAAGACTAGG | 1010 |

Example 63. Generation of DeltaThyA

An auxotrophic mutation causes bacteria to die in the absence of an exogenously added nutrient essential for survival or growth because they lack the gene(s) necessary to produce that essential nutrient. In order to generate genetically engineered bacteria with an auxotrophic modification, the thyA, a gene essential for oligonucleotide synthesis was deleted. Deletion of the thyA gene in E. coli Nissle yields a strain that cannot form a colony on LB plates unless they are supplemented with thymidine.

A thyA::cam PCR fragment was amplified using 3 rounds of PCR as follows. Sequences of the primers used at a 100 um concentration are found in Table 125.

TABLE 125

Primer Sequences

| Name | Sequence | Description | SEQ ID NO |
|---|---|---|---|
| SR36 | tagaactgatgcaaaaagtgctcgacgaaggcacacagaTGTGTAGGCTGGAGCTGCTTC | Round 1: binds on pKD3 | SEQ ID NO: 1011 |
| SR38 | gtttcgtaattagatagccaccggcgctttaatgcccggaCATATGAATATCCTCCTTAG | Round 1: binds on pKD3 | SEQ ID NO: 1012 |
| SR33 | caacacgtttcctgaggaaccatgaaacagtatttagaactgatgcaaaaag | Round 2: binds to round 1 PCR product | SEQ ID NO: 1013 |
| SR34 | cgcacactggcgtcggctctggcaggatgtttcgtaattagatagc | Round 2: binds to round 1 PCR product | SEQ ID NO: 1013 |
| SR43 | atatcgtcgcagcccacagcaacacgtttcctgagg | Round 3: binds to round 2 PCR product | SEQ ID NO: 1014 |
| SR44 | aagaatttaacggagggcaaaaaaaaccgacgcacactggcgtcggc | Round 3: binds to round 2 PCR product | SEQ ID NO: 1015 |

For the first PCR round, 4×50 ul PCR reactions containing pKD3 as template, 25 ul 2× phusion, 0.2 ul primer SR36 and SR38, and either 0, 0.2, 0.4 or 0.6 ul DMSO were brought up to 50 ul volume with nuclease free water and amplified under the following cycle conditions:
  step1: 98c for 30 s
  step2: 98c for 10 s
  step3: 55c for 15 s
  step4: 72c for 20 s
  repeat step 2-4 for 30 cycles
  step5: 72c for 5 min Subsequently, 5 ul of each PCR reaction was run on an agarose gel to confirm PCR product of the appropriate size. The PCR product was purified from the remaining PCR reaction using a Zymoclean gel DNA recovery kit according to the manufacturer's instructions and eluted in 30 ul nuclease free water.

For the second round of PCR, 1 ul purified PCR product from round 1 was used as template, in 4×50 ul PCR reactions as described above except with 0.2 ul of primers SR33 and SR34. Cycle conditions were the same as noted above for the first PCR reaction. The PCR product run on an agarose gel to verify amplification, purified, and eluted in 30 ul as described above.

For the third round of PCR, 1 ul of purified PCR product from round 2 was used as template in 4×50 ul PCR reactions as described except with primer SR43 and SR44. Cycle conditions were the same as described for rounds 1 and 2. Amplification was verified, the PCR product purified, and eluted as described above. The concentration and purity was measured using a spectrophotometer. The resulting linear DNA fragment, which contains 92 bp homologous to upstream of thyA, the chloramphenicol cassette flanked by frt sites, and 98 bp homologous to downstream of the thyA gene, was transformed into a E. coli Nissle 1917 strain containing pKD46 grown for recombineering. Following electroporation, 1 ml SOC medium containing 3 mM thymidine was added, and cells were allowed to recover at 37 C for 2 h with shaking. Cells were then pelleted at 10,000×g for 1 minute, the supernatant was discarded, and the cell pellet was resuspended in 100 ul LB containing 3 mM thymidine and spread on LB agar plates containing 3 mM thy and 20 ug/ml chloramphenicol. Cells were incubated at 37 C overnight. Colonies that appeared on LB plates were restreaked. +cam 20 ug/ml+ or −thy 3 mM. (thyA auxotrophs will only grow in media supplemented with thy 3 mM).

Next, the antibiotic resistance was removed with pCP20 transformation. pCP20 has the yeast Flp recombinase gene, FLP, chloramphenicol and ampicillin resistant genes, and temperature sensitive replication. Bacteria were grown in LB media containing the selecting antibiotic at 37° C. until OD600=0.4-0.6. 1 mL of cells were washed as follows: cells were pelleted at 16,000×g for 1 minute. The supernatant was discarded and the pellet was resuspended in 1 mL ice-cold 10% glycerol. This wash step was repeated 3× times. The final pellet was resuspended in 70 ul ice-cold 10% glycerol. Next, cells were electroporated with ing pCP20 plasmid DNA, and 1 mL SOC supplemented with 3 mM thymidine was immediately added to the cuvette. Cells were resuspended and transferred to a culture tube and grown at 30° C. for 1 hours. Cells were then pelleted at 10,000×g for 1 minute, the supernatant was discarded, and the cell pellet was resuspended in 100 ul LB containing 3 mM thymidine and spread on LB agar plates containing 3 mM thy and 100 ug/ml carbenicillin and grown at 30° C. for 16-24 hours. Next, transformants were colony purified non-selectively (no antibiotics) at 42° C.

To test the colony-purified transformants, a colony was picked from the 42° C. plate with a pipette tip and resuspended in 10 µL LB. 3 µL of the cell suspension was pipetted onto a set of 3 plates: Cam, (37° C.; tests for the presence/absence of CamR gene in the genome of the host strain), Amp, (30° C., tests for the presence/absence of AmpR from the pCP20 plasmid) and LB only (desired cells that have lost the chloramphenicol cassette and the pCP20 plasmid), 37° C. Colonies were considered cured if there is no growth in neither the Cam or Amp plate, picked, and re-streaked on an LB plate to get single colonies, and grown overnight at 37° C.

TABLE 124

Wild Type clbA and clbA knock out
Example 64. Wild Type clbA and clbA knock out

Wild-type clbA (SEQ ID NO: 1016)
```
caaatatcacataatcttaacatatcaataaacacagtaaagtttcatgtgaaaaacatcaaacataaaata
caagctcggaatacgaatcacgctatacacattgctaacaggaatgagattatctaaatgaggattgatat
attaattggacatactagttttttttcatcaaaccagtagagataacttccttcactatctcaatgaggaagaaa
taaaacgctatgatcagtttcattttgtgagtgataaagaactctatattttaagccgtatcctgctcaaaaca
gcactaaaaagatatcaacctgatgtctcattacaatcatggcaatttagtacgtgcaaatatggcaaacc
atttatagttttttcctcagttggcaaaaaagatttttttttaaccttttcccatactatagatacagtagccgttgct
attagttctcactgcgagcttggtgtcgatattgaacaaataagagatttagacaactcttatctgaatatca
gtcagcattttttttactccacaggaagctactaacatagtttcacttcctcgttatgaaggtcaattactttttttg
gaaaatgtggacgctcaaagaagcttacatcaaatatcgaggtaaaggcctatctttaggactggattgt
attgaatttcatttaacaaataaaaaactaacttcaaaatatagaggttcacctgtttatttctctcaatggaaa
atatgtaactcatttctcgcattagcctctccactcatccccctaaaataactattgagctatttcctatgca
gtcccaactttatcaccacgactatcagctaattcattcgtcaaatgggcagaattgaatcgccacggata
atctagacacttctgagccgtcgataatattgattttcatattccgtcggtggtgtaagtatcccgcataatc
gtgccattcacatttag
``` clbA knockout (SEQ ID NO: 1017)
```
ggatggggggaaacatggataagttcaaagaaaaaaacccgttatctctgcgtgaaagacaagtattgc
gcatgctggcacaaggtgatgagtactctcaaatatcacataatcttaacatatcaataaacacagtaaag
tttcatgtgaaaaacatcaaacataaaatacaagctcggaatacgaatcacgctatacacattgctaacag
gaatgagattatctaaatgaggattgaTGTGTAGGCTGGAGCTGCTTCGAAGTT
CCTATACTTTCTAGAGAATAGGAACTTCGGAATAGGAACTTCG
GAATAGGAACTAAGGAGGATATTCATATGtcgtcaaatgggcagaattgaa
tcgccacggataatctagacacttctgagccgtcgataatattgattttcatattccgtcggtgg
```

SEQUENCE LISTING (1052 sequences)

SEQ ID NO: 1 - protein, 447 aa, Artificial Sequence
  Synthetic: Heavy chain humanized
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2 - protein, 218 aa, Artificial Sequence
  Synthetic: Light chain humanized
EIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3 - protein, 440 aa, Artificial Sequence
  Synthetic: Heavy chain human monoclonal
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 4 - protein, 214 aa, Artificial Sequence
  Synthetic: Light chain human monoclonal
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5 - protein, 448 aa, Artificial Sequence
  Synthetic: Ipilimumab, CTLA-4, Heavy chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6 - protein, 118 aa, Artificial Sequence
  Synthetic: Ipilimumab , CTLA-4, Heavy chain variable region
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 7 - protein, 215 aa, Artificial Sequence
  Synthetic: Ipilimumab, CTLA-4, Light chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8 - protein, 108 aa, Artificial Sequence
  Synthetic: Ipilimumab, CTLA-4, Light chain variable region
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 9 - protein, 411 aa, Artificial Sequence
  Synthetic: Tremelimumab (CP675206), CTLA-4, Heavy chain
PGKGLEWVAVIWYDGSNKYYADSVKGRFTISRDNSKNTLYLQMNSLRAEDTAVYYCARDPRGATLYYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 10 - protein, 214 aa, Artificial Sequence
  Synthetic: Tremelimumab (CP675206), CTLA-4, Light chain
DIQMTQSPSSLSASVGDRVTITCRASQSINSYLDWYQQKPGKAPKLLIYAASSLQSGVPSRFSGSGSGTDFTLTISSLQPEDFATYYCQQYYSTPFTFGPGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11 - protein, 442 aa, Artificial Sequence
  Synthetic: PF-05082566, 4-1BB (CD137, TNFRSF9), Heavy chain
EVQLVQSGAEVKKPGESLRISCKGSGYSFSTYWISWVRQMPGKGLEWMGKIYPGDSYTNYSPSFQGQVTISADKSISTAYLQWSSLKASDTAMYYCARGYGIFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 12 - protein, 214 aa, Artificial Sequence
  Synthetic: PF-05082566, 4-1BB (CD137, TNFRSF9), Light chain
SYELTQPPSVSVSPGQTASITCSGDNIGDQYAHWYQQKPGQSPVLVIYQDKNRPSGIPERFSGSNSGNTATLTISGTQAMDEADYYCATYTGFGSLAVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 13 - protein, 448 aa, Artificial Sequence
  Synthetic: Urelumab, 4-1BB (CD137, TNFRSF9), Heavy chain
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 14 - protein, 216 aa, Artificial Sequence
  Synthetic: Urelumab, 4-1BB (CD137, TNFRSF9), Light chain
EIVLTQSPATLSLSPGERATLSCRASQSVSSYLAWYQQKPGQAPRLLIYDASNRATGIPARFSGSGSGTDFTLTISSLEPEDFAVYYCQQRSNWPPALTFCGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15 - protein, 117 aa, Artificial Sequence
  Synthetic: Anti-OX40 antibody (Providence Health and Services), CD134 (OX40), Heavy chain
EVQLVESGGGLVQPGGSLRLSCAASGFTFTNYGIHWIRQAPGKGLEWVASISPSGGLTYYRDSVKGRFTISRDDAKNSPYLQMNSLRAEDTAVYYCATGGEGIFDYWGQGTLVTVSS

SEQ ID NO: 16 - protein, 108 aa, Artificial Sequence
  Synthetic: Anti-OX40 antibody (Providence Health and Services), CD134 (OX40), Light chain
DIQMTQSPSSLSASVGDRVTITCRATQSIYNALAWYQQKPGKAPKLLIYNANTLHTGVPSRFSASGSGTDSTLTISSLQPEDFATYYCQQYYDYPLTFGGGTKVEIKR

SEQ ID NO: 17 - protein, 440 aa, Artificial Sequence; identical to SEQ ID NO: 3
  Synthetic: Nivolumab, PD-1, Heavy chain

SEQ ID NO: 18 - protein, 113 aa, Artificial Sequence [sequence omitted]

SEQ ID NO: 19 - protein, 214 aa, Artificial Sequence; identical to SEQ ID NO: 4
  Synthetic: Nivolumab, PD-1, Light chain

SEQ ID NO: 20 - protein, 107 aa, Artificial Sequence [sequence omitted]

SEQ ID NO: 21 - protein, 447 aa, Artificial Sequence
  Synthetic: Pidilizumab, PD-1, Heavy chain
QVQLVQSGSELKKPGASVKISCKASGYTFTNYGMNWVRQAPGQGLQWMGWINTDSGESTYAEEFKGRFVFSLDTSVNTAYLQITSLTAEDTGMYFCVRVGYDALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 22 - skipped

SEQ ID NO: 23 - protein, 213 aa, Artificial Sequence
  Synthetic: Pidilizumab, PD-1, Light chain
EIVLTQSPSSLSASVGDRVTITCSARSSVSYMHWFQQKPGKAPKLWIYRTSNLASGVPSRFSGSGSGTSYCLTINSLQPEDFATYYCQQRSSFPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24 - skipped

SEQ ID NO: 25 - protein, 447 aa, Artificial Sequence; identical to SEQ ID NO: 1
  Synthetic: Pembrolizumab (MK-3475/SCH900475, lambrolizumab) PD-1, Heavy chain

SEQ ID NO: 26 - protein, 218 aa, Artificial Sequence; identical to SEQ ID NO: 2
  Synthetic: Pembrolizumab (MK-3475/SCH900475, lambrolizumab), PD-1, Light chain; Heavy chain variable region is described in as described in WO2009114335

SEQ ID NO: 27 - protein, 451 aa, Artificial Sequence
  Synthetic: Durvalumab (MEDI4736), PD-L1, Heavy chain
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 28 - protein, 215 aa, Artificial Sequence
  Synthetic: Durvalumab (MEDI4736), PD-L1, Light chain
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 29 - protein, 450 aa, Artificial Sequence
  Synthetic: Lirilumab, KIR, Heavy chain
QVQLVQSGAEVKKPGSSVKVSCKASGGTFSFYAISWVRQAPGQGLEWMGGFIPIFGAANYAQKFQGRVTITADESTSTAYMELSSLRSDDTAVYYCARIPSGSYYYDYDMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 30 - protein, 214 aa, Artificial Sequence
  Synthetic: Lirilumab, KIR, Light chain
EIVLTQSPVTLSLSPGERATLSCRASQSVSSYLAWYQQKPGQAPRLLIYDASNRATGIPARFSGSGSGTDFTLTISSLEPEDFAVYYCQQRSNWMYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 31 - protein, 447 aa, Artificial Sequence
  Synthetic: BMS-986016, LAG3, Heavy chain
QVQLQQWGAGLLKPSETLSLTCAVYGGSFSDYYWNWIRQPPGKGLEWIGEINHRGSTNSNPSLKSRVTLSLDTSKNQFSLKLRSVTAADTAVYYCAFGYSDYEYNWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 32 - protein, 214 aa, Artificial Sequence
  Synthetic: BMS986016, LAG3, Light chain
EIVLTQSPATLSLSPGERATLSCRASQSISSYLAWYQQKPGQAPRLLIYDASNRATGIPARFSGSGSGTDFTLTISSLEPEDFAVYYCQQRSNWPLTFGQGTNLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 33 - protein, 450 aa, Artificial Sequence
  Synthetic: Avelumab  (MSB0010718C), PD-L1, Heavy chain
EVQLLESGGGLVQPGGSLRLSCAASGFTFSSYIMMWVRQAPGKGLEWVSSIYPSGGITFYADTVKGRFTISRDNSKNTLYLQMNSLRAEDTAVYYCARIKLGTVTTVDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 34 - protein, 216 aa, Artificial Sequence
  Synthetic: Avelumab  (MSB0010718C), PD-L1, Light chain
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 35 - protein, 448 aa, Artificial Sequence
  Synthetic: Atezolizumab (MPDL3280A, RG7446,  RO5541267) PD-L1, Heavy chain
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36 - protein, 118 aa, Artificial Sequence [sequence omitted]

SEQ ID NO: 37 - protein, 214 aa, Artificial Sequence
  Synthetic: Atezolizumab (MPDL3280A, RG7446,  RO5541267), PD-L1, Light chain
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 38 - protein, 108 aa, Artificial Sequence
  Synthetic: Atezolizumab (MPDL3280A, RG7446,  RO5541267), PD-L1, Light chain variable region
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKR

SEQ ID NO: 39 - protein, 449 aa, Artificial Sequence
  Synthetic: Mogamulizumab, CCR4, Heavy chain
EVQLVESGGDLVQPGRSLRLSCAASGFIFSNYGMSWVRQAPGKGLEWVATISSASTYSYYPDSVKGRFTISRDNAKNSLYLQMNSLRVEDTALYYCGRHSDGNFAFGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 40 - protein, 219 aa, Artificial Sequence
  Synthetic: Mogamulizumab, CCR4, Light chain
DVLMTQSPLSLPVTPGEPASISCRSSRNIVHINGDTYLEWYLQKPGQSPQLLIYKVSNRFSGVPDRFSGSGSGTDFTLKISRVEAEDVGVYYCFQGSLLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 41 - protein, 452 aa, Artificial Sequence
  Synthetic: Varlilumab, CD27, Heavy chain
QVQLVESGGGVVQPGRSLRLSCAASGFTFSSYDMHWVRQAPGKGLEWVAVIWYDGSNKYYADSVKGRFTISRDNSKNTLYLQMNSLRAEDTAVYYCARGSGNWGFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGSS

SEQ ID NO: 42 - protein, 214 aa, Artificial Sequence
  Synthetic: Varlilumab, CD27, Light chain
DIQMTQSPSSLSASVGDRVTITCRASQGISRWLAWYQQKPEKAPKSLIYAASSLQSGVPSRFSGSGSGTDFTLTISSLQPEDFATYYCQQYNTYPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 43 - protein, 451 aa, Artificial Sequence
  Synthetic: Ulocuplumab, CXCR4, Heavy chain
EVQLVESGGGLVQPGGSLRLSCAAAGFTFSSYSMNWVRQAPGKGLEWVSYISSRSRTIYYADSVKGRFTISRDNAKNSLYLQMNSLRDEDTAVYYCARDYGGQPPYYYYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 44 - protein, 214 aa, Artificial Sequence
  Synthetic: Ulocuplumab, CXCR4, Light chain
DIQMTQSPSSLSASVGDRVTITCRASQGISSWLAWYQQKPEKAPKSLIYAASSLQSGVPSRFSGSGSGTDFTLTISSLQPEDFVTYYCQQYNSYPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 45 - protein, 450 aa, Artificial Sequence
  Synthetic: Bavituximab, Phosphatidyl Serine, Heavy chain
EVQLQQSGPELEKPGASVKLSCKASGYSFTGYNMNWVKQSHGKSLEWIGHIDPYYGDTSYNQKFRGKATLTVDKSSSTAYMQLKSLTSEDSAVYYCVKGGYYGHWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 46 - protein, 164 aa, Artificial Sequence
  Synthetic: Bavituxumab, Phosphatidyl Serine, Light chain
TSSLDSGVPKRFSGSRSGSDYSLTISSLESEDFVDYYCLQYVSSPPTFGAGTKLELKRADAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 47 - DNA, 7584 bp, Artificial Sequence
  Synthetic: Tet-regulated Tryptophan operon
taagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaactctagaaataattttgtttaactttaagaaggagatatacatatgcaaacacaaaaaccgactctcgaactgctaacctgcgaaggcgcttatcgcgacaacccgactgcgctttttcaccagttgtgtggggatcgtccggcaacgctgctgctggaatccgcagatatcgacagcaaagatgatttaaaaagcctgctgctggtagacagtgcgctgcgcattacagcattaagtgacactgtcacaatccaggcgctttccggcaatggagaagccctgttgacactactggataacgccttgcctgcgggtgtggaaaatgaacaatcaccaaactgccgcgtactgcgcttcccgcctgtcagtccactgctggatgaagacgcccgcttatgctccctttcggtttttgacgctttccgcttattacagaatctgttgaatgtaccgaaggaagaacgagaagcaatgttcttcggcggcctgttctcttatgaccttgtggcgggatttgaaaatttaccgcaactgtcagcggaaaatagctgccctgatttctgtttttatctcgctgaaacgctgatggtgattgaccatcagaaaaaaagcactcgtattcaggccagcctgtttgctccgaatgaagaagaaaaacaacgtctcactgctcgcctgaacgaactacgtcagcaactgaccgaagccgcgccgccgctgccggtggtttccgtgccgcatatgcgttgtgaatgtaaccagagcgatgaagagttcggtggtgtagtgcgtttgttgcaaaaagcgattcgcgccggagaaattttccaggtggtgccatctcgccgtttctctctgccctgcccgtcaccgctggcagcctattacgtgctgaaaaagagtaatcccagcccgtacatgttttttatgcaggataatgatttcaccctgtttggcgcgtcgccggaaagttcgctcaagtatgacgccaccagccgccagattgagatttacccgattgccggaacacgtccacgcggtcgtcgtgccgatggttcgctggacagagacctcgacagccgcatcgaactggagatgcgtaccgatcataaagagctttctgaacatctgatgctggtggatctcgcccgtaatgacctggcacgcatttgcacacccggcagccgctacgtcgccgatctcaccaaagttgaccgttactcttacgtgatgcacctagtctcccgcgttgttggtgagctgcgccacgatctcgacgccctgcacgcttaccgcgcctgtatgaatatggggacgttaagcggtgcaccgaaagtacgcgctatgcagttaattgccgaagcagaaggtcgtcgacgcggcagctacggcggcgcggtaggttattttaccgcgcatggcgatctcgacacctgcattgtgatccgctcggcgctggtggaaaacggtatcgccaccgtgcaagccggtgctggcgtagtccttgattctgttccgcagtcggaagccgacgaaactcgtaataaagcccgcgctgtactgcgcgctattgccaccgcgcatcatgcacaggagacgttctaatggctgacattctgctgctcgataatatcgactcttttacgtacaacctggcagatcagttgcgcagcaatggtcataacgtggtgatttaccgcaaccatattccggcgcagaccttaattgaacgcctggcgacgatgagcaatccggtgctgatgctttctcctggccccggtgtgccgagcgaagccggttgtatgccggaactcctcacccgcttgcgtggcaagctgccaattattggcatttgcctcggacatcaggcgattgtcgaagcttacgggggctatgtcggtcaggcgggcgaaattcttcacggtaaagcgtcgagcattgaacatgacggtcaggcgatgtttgccggattaacaaacccgctgccagtggcgcgttatcactcgctggttggcagtaacattccggccggtttaaccatcaacgcccattttaatggcatggtgatggcggtgcgtcacgatgcagatcgcgtttgtggattccagttccatccggaatccattcttactacccagggcgctcgcctgctggaacaaacgctggcctgggcgcagcagaaactagagccaaccaacacgctgcaaccgattctggaaaaactgtatcaggcacagacgcttagccaacaagaaagccaccagctgttttcagcggtggtacgtggcgagctgaagccggaacaactggcggcggcgctggtgagcatgaaaattcgcggtgaacacccgaacgagatcgccggggcagcaaccgcgctactggaaaacgccgcgccattcccgcgcccggattatctgtttgccgatatcgtcggtactggcggtgacggcagcaacagcatcaatatttctaccgccagtgcgtttgtcgccgcggcctgcgggctgaaagtggcgaaacacggcaaccgtagcgtctccagtaaatccggctcgtcggatctgctggcggcgttcggtattaatcttgatatgaacgccgataaatcgcgccaggcgctggatgagttaggcgtctgtttcctctttgcgccgaagtatcacaccggattccgccatgcgatgccggttcgccagcaactgaaaacccgcactctgttcaacgtgctgggaccattgattaacccggcgcatccgccgctggcgctaattggtgtttatagtccggaactggtgctgccgattgccgaaaccttgcgcgtgctggggtatcaacgcgcggcagtggtgcacagcggcgggatggatgaagtttcattacacgcgccgacaatcgttgccgaactacatgacggcgaaattaagagctatcaattgaccgctgaagattttggcctgacaccctaccaccaggagcaattggcaggcggaacaccggaagaaaaccgtgacattttaacacgcttgttacaaggtaaaggcgacgccgcccatgaagcagccgtcgcggcgaatgtcgccatgttaatgcgcctgcatggccatgaagatctgcaagccaatgcgcaaaccgttcttgaggtactgcgcagtggttccgcttacgacagagtcaccgcactggcggcacgagggtaaatgatgcaaaccgttttagcgaaaatcgtcgcagacaaggcgatttgggtagaaacccgcaaagagcagcaaccgctggccagttttcagaatgaggttcagccgagcacgcgacatttttatgatgcacttcagggcgcacgcacggcgtttattctggagtgtaaaaaagcgtcgccgtcaaaaggcgtgatccgtgatgatttcgatccggcacgcattgccgccatttataaacattacgcttcggcaatttcagtgctgactgatgagaaatattttcaggggagctttgatttcctccccatcgtcagccaaatcgccccgcagccgattttatgtaaagacttcattatcgatccttaccagatctatctggcgcgctattaccaggccgatgcctgcttattaatgctttcagtactggatgacgaacaatatcgccagcttgcagccgtcgcccacagtctggagatgggtgtgctgaccgaagtcagtaatgaagaggaactggagcgcgccattgcattgggggcaaaggtcgttggcatcaacaaccgcgatctgcgcgatttgtcgattgatctcaaccgtacccgcgagcttgcgccgaaactggggcacaacgtgacggtaatcagcgaatccggcatcaatacttacgctcaggtgcgcgagttaagccacttcgctaacggctttctgattggttcggcgttgatggcccatgacgatttgaacgccgccgtgcgtcgggtgttgctgggtgagaataaagtatgtggcctgacacgtgggcaagatgctaaagcagcttatgacgcgggcgcgatttacggtgggttgatttttgttgcgacatcaccgcgttgcgtcaacgttgaacaggcgcaggaagtgatggctgcagcaccgttgcagtatgttggcgtgttccgcaatcacgatattgccgatgtggcggacaaagctaaggtgttatcgctggcggcagtgcaactgcatggtaatgaagatcagctgtatatcgacaatctgcgtgaggctctgccagcacacgtcgccatctggaaggctttaagtgtcggtgaaactcttcccgcgcgcgattttcagcacatcgataaatatgtattcgacaacggtcagggcgggagcggacaacgtttcgactggtcactattaaatggtcaatcgcttggcaacgttctgctggcggggggcttaggcgcagataactgcgtggaagcggcacaaaccggctgcgccgggcttgattttaattctgctgtagagtcgcaaccgggtatcaaagacgcacgtcttttggcctcggttttccagacgctgcgcgcatattaaggaaaggaacaatgacaacattacttaacccctattttggtgagtttggcggcatgtacgtgccacaaatcctgatgcctgctctgcgccagctggaagaagcttttgtcagcgcgcaaaaagatcctgaatttcaggctcagttcaacgacctgctgaaaaactatgccgggcgtccaaccgcgctgaccaaatgccagaacattacagccgggacgaacaccacgctgtatctgaagcgcgaagatttgctgcacggcggcgcgcataaaactaaccaggtgctcggtcaggctttactggcgaagcggatgggtaaaactgaaattattgccgaaaccggtgccggtcagcatggcgtggcgtcggcccttgccagcgccctgctcggcctgaaatgccgaatttatatgggtgccaaagacgttgaacgccagtcgcccaacgttttccggatgcgcttaatgggtgcggaagtgatcccggtacatagcggttccgcgaccctgaaagatgcctgtaatgaggcgctacgcgactggtccggcagttatgaaaccgcgcactatatgctgggtaccgcagctggcccgcatccttacccgaccattgtgcgtgagtttcagcggatgattggcgaagaaacgaaagcgcagattctggaaagagaaggtcgcctgccggatgccgttatcgcctgtgttggcggtggttcgaatgccatcggtatgtttgcagatttcatcaacgaaaccgacgtcggcctgattggtgtggagcctggcggccacggtatcgaaactggcgagcacggcgcaccgttaaaacatggtcgcgtgggcatctatttcggtatgaaagcgccgatgatgcaaaccgaagacgggcaaattgaagagtcttactccatttctgccgggctggatttcccgtccgtcggcccgcaacatgcgtatctcaacagcactggacgcgctgattacgtgtctattaccgacgatgaagccctggaagcctttaaaacgctttgcctgcatgaagggatcatcccggcgctggaatcctcccacgccctggcccatgcgctgaaaatgatgcgcgaaaatccggaaaaagagcagctactggtggttaacctttccggtcgcggcgataaagacatcttcaccgttcacgatattttgaaagcacgaggggaaatctgatggaacgctacgaatctctgtttgcccagttgaaggagcgcaaagaaggcgcattcgttcctttcgtcaccctcggtgatccgggcattgagcagtcgttgaaaattatcgatacgctaattgaagccggtgctgacgcgctggagttaggcatccccttctccgacccactggcggatggcccgacgattcaaaacgccacactgcgtgcttttgcggcgggagtaaccccggcgcagtgctttgagatgctggcactcattcgccagaagcacccgaccattcccatcggccttttgatgtatgccaacctggtgtttaacaaaggcattgatgagttttatgccgagtgcgagaaagtcggcgtcgattcggtgctggttgccgatgtgcccgtggaagagtccgcgcccttccgccaggccgcgttgcgtcataatgtcgcacctatctttatttgcccgccgaatgccgacgatgatttgctgcgccagatagcctcttacggtcgtggttacacctatttgctgtcgcgagcgggcgtgaccggcgcagaaaaccgcgccgcgttacccctcaatcatctggttgcgaagctgaaagagtacaacgctgcgcctccattgcagggatttggtatttccgccccggatcaggtaaaagccgcgattgatgcaggagctgcgggcgcgatttctggttcggccatcgttaaaatcatcgagcaacatattaatgagccagagaaaatgctggcggcactgaaagcttttgtacaaccgatgaaagcggcgacgcgcagttaatacgcatggcatggatgaccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtggccagtgccaagcttgcatgcgtgc

SEQ ID NO: 48 - DNA, 623 bp, Artificial Sequence
  Synthetic: Tet repressor
taagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacat

SEQ ID NO: 49 - DNA, 124 bp, Artificial Sequence
  Synthetic: tetR/tetA promoters and RBS and leader region
cattaattcctaatttttgttgacactctatcattgatagagttattttaccactccctatcagtgatagagaaaagtgaactctagaaataattttgtttaactttaagaaggagatatacat

SEQ ID NO: 50 - DNA, 1562 bp, Artificial Sequence
  Synthetic: trpE
atgcaaacacaaaaaccgactctcgaactgctaacctgcgaaggcgcttatcgcgacaacccgactgcgctttttcaccagttgtgtggggatcgtccggcaacgctgctgctggaatccgcagatatcgacagcaaagatgatttaaaaagcctgctgctggtagacagtgcgctgcgcattacagcattaagtgacactgtcacaatccaggcgctttccggcaatggagaagccctgttgacactactggataacgccttgcctgcgggtgtggaaaatgaacaatcaccaaactgccgcgtactgcgcttcccgcctgtcagtccactgctggatgaagacgcccgcttatgctccctttcggtttttgacgctttccgcttattacagaatctgttgaatgtaccgaaggaagaacgagaagcaatgttcttcggcggcctgttctcttatgaccttgtggcgggatttgaaaatttaccgcaactgtcagcggaaaatagctgccctgatttctgtttttatctcgctgaaacgctgatggtgattgaccatcagaaaaaaagcactcgtattcaggccagcctgtttgctccgaatgaagaagaaaaacaacgtctcactgctcgcctgaacgaactacgtcagcaactgaccgaagccgcgccgccgctgccggtggtttccgtgccgcatatgcgttgtgaatgtaaccagagcgatgaagagttcggtggtgtagtgcgtttgttgcaaaaagcgattcgcgccggagaaattttccaggtggtgccatctcgccgtttctctctgccctgcccgtcaccgctggcagcctattacgtgctgaaaaagagtaatcccagcccgtacatgttttttatgcaggataatgatttcaccctgtttggcgcgtcgccggaaagttcgctcaagtatgacgccaccagccgccagattgagatttacccgattgccggaacacgtccacgcggtcgtcgtgccgatggttcgctggacagagacctcgacagccgcatcgaactggagatgcgtaccgatcataaagagctttctgaacatctgatgctggtggatctcgcccgtaatgacctggcacgcatttgcacacccggcagccgctacgtcgccgatctcaccaaagttgaccgttactcttacgtgatgcacctagtctcccgcgttgttggtgagctgcgccacgatctcgacgccctgcacgcttaccgcgcctgtatgaatatggggacgttaagcggtgcaccgaaagtacgcgctatgcagttaattgccgaagcagaaggtcgtcgacgcggcagctacggcggcgcggtaggttattttaccgcgcatggcgatctcgacacctgcattgtgatccgctcggcgctggtggaaaacggtatcgccaccgtgcaagccggtgctggcgtagtccttgattctgttccgcagtcggaagccgacgaaactcgtaataaagcccgcgctgtactgcgcgctattgccaccgcgcatcatgcacaggagacgttcta

SEQ ID NO: 51 - DNA, 1596 bp, Artificial Sequence
  Synthetic: trpD
atggctgacattctgctgctcgataatatcgactcttttacgtacaacctggcagatcagttgcgcagcaatggtcataacgtggtgatttaccgcaaccatattccggcgcagaccttaattgaacgcctggcgacgatgagcaatccggtgctgatgctttctcctggccccggtgtgccgagcgaagccggttgtatgccggaactcctcacccgcttgcgtggcaagctgccaattattggcatttgcctcggacatcaggcgattgtcgaagcttacgggggctatgtcggtcaggcgggcgaaattcttcacggtaaagcgtcgagcattgaacatgacggtcaggcgatgtttgccggattaacaaacccgctgccagtggcgcgttatcactcgctggttggcagtaacattccggccggtttaaccatcaacgcccattttaatggcatggtgatggcggtgcgtcacgatgcagatcgcgtttgtggattccagttccatccggaatccattcttactacccagggcgctcgcctgctggaacaaacgctggcctgggcgcagcagaaactagagccaaccaacacgctgcaaccgattctggaaaaactgtatcaggcacagacgcttagccaacaagaaagccaccagctgttttcagcggtggtacgtggcgagctgaagccggaacaactggcggcggcgctggtgagcatgaaaattcgcggtgaacacccgaacgagatcgccggggcagcaaccgcgctactggaaaacgccgcgccattcccgcgcccggattatctgtttgccgatatcgtcggtactggcggtgacggcagcaacagcatcaatatttctaccgccagtgcgtttgtcgccgcggcctgcgggctgaaagtggcgaaacacggcaaccgtagcgtctccagtaaatccggctcgtcggatctgctggcggcgttcggtattaatcttgatatgaacgccgataaatcgcgccaggcgctggatgagttaggcgtctgtttcctctttgcgccgaagtatcacaccggattccgccatgcgatgccggttcgccagcaactgaaaacccgcactctgttcaacgtgctgggaccattgattaacccggcgcatccgccgctggcgctaattggtgtttatagtccggaactggtgctgccgattgccgaaaccttgcgcgtgctggggtatcaacgcgcggcagtggtgcacagcggcgggatggatgaagtttcattacacgcgccgacaatcgttgccgaactacatgacggcgaaattaagagctatcaattgaccgctgaagattttggcctgacaccctaccaccaggagcaattggcaggcggaacaccggaagaaaaccgtgacattttaacacgcttgttacaaggtaaaggcgacgccgcccatgaagcagccgtcgcggcgaatgtcgccatgttaatgcgcctgcatggccatgaagatctgcaagccaatgcgcaaaccgttcttgaggtactgcgcagtggttccgcttacgacagagtcaccgcactggcggcacgagggtaa

SEQ ID NO: 52 - DNA, 1359 bp, Artificial Sequence
  Synthetic: trpC
atgcaaaccgttttagcgaaaatcgtcgcagacaaggcgatttgggtagaaacccgcaaagagcagcaaccgctggccagttttcagaatgaggttcagccgagcacgcgacatttttatgatgcacttcagggcgcacgcacggcgtttattctggagtgtaaaaaagcgtcgccgtcaaaaggcgtgatccgtgatgatttcgatccggcacgcattgccgccatttataaacattacgcttcggcaatttcagtgctgactgatgagaaatattttcaggggagctttgatttcctccccatcgtcagccaaatcgccccgcagccgattttatgtaaagacttcattatcgatccttaccagatctatctggcgcgctattaccaggccgatgcctgcttattaatgctttcagtactggatgacgaacaatatcgccagcttgcagccgtcgcccacagtctggagatgggtgtgctgaccgaagtcagtaatgaagaggaactggagcgcgccattgcattgggggcaaaggtcgttggcatcaacaaccgcgatctgcgcgatttgtcgattgatctcaaccgtacccgcgagcttgcgccgaaactggggcacaacgtgacggtaatcagcgaatccggcatcaatacttacgctcaggtgcgcgagttaagccacttcgctaacggctttctgattggttcggcgttgatggcccatgacgatttgaacgccgccgtgcgtcgggtgttgctgggtgagaataaagtatgtggcctgacacgtgggcaagatgctaaagcagcttatgacgcgggcgcgatttacggtgggttgatttttgttgcgacatcaccgcgttgcgtcaacgttgaacaggcgcaggaagtgatggctgcagcaccgttgcagtatgttggcgtgttccgcaatcacgatattgccgatgtggcggacaaagctaaggtgttatcgctggcggcagtgcaactgcatggtaatgaagatcagctgtatatcgacaatctgcgtgaggctctgccagcacacgtcgccatctggaaggctttaagtgtcggtgaaactcttcccgcgcgcgattttcagcacatcgataaatatgtattcgacaacggtcagggcgggagcggacaacgtttcgactggtcactattaaatggtcaatcgcttggcaacgttctgctggcggggggcttaggcgcagataactgcgtggaagcggcacaaaccggctgcgccgggcttgattttaattctgctgtagagtcgcaaccgggtatcaaagacgcacgtcttttggcctcggttttccagacgctgcgcgcatattaa

SEQ ID NO: 53 - DNA, 1194 bp, Artificial Sequence
  Synthetic: trpB
atgacaacattacttaacccctattttggtgagtttggcggcatgtacgtgccacaaatcctgatgcctgctctgcgccagctggaagaagcttttgtcagcgcgcaaaaagatcctgaatttcaggctcagttcaacgacctgctgaaaaactatgccgggcgtccaaccgcgctgaccaaatgccagaacattacagccgggacgaacaccacgctgtatctgaagcgcgaagatttgctgcacggcggcgcgcataaaactaaccaggtgctcggtcaggctttactggcgaagcggatgggtaaaactgaaattattgccgaaaccggtgccggtcagcatggcgtggcgtcggcccttgccagcgccctgctcggcctgaaatgccgaatttatatgggtgccaaagacgttgaacgccagtcgcccaacgttttccggatgcgcttaatgggtgcggaagtgatcccggtacatagcggttccgcgaccctgaaagatgcctgtaatgaggcgctacgcgactggtccggcagttatgaaaccgcgcactatatgctgggtaccgcagctggcccgcatccttacccgaccattgtgcgtgagtttcagcggatgattggcgaagaaacgaaagcgcagattctggaaagagaaggtcgcctgccggatgccgttatcgcctgtgttggcggtggttcgaatgccatcggtatgtttgcagatttcatcaacgaaaccgacgtcggcctgattggtgtggagcctggcggccacggtatcgaaactggcgagcacggcgcaccgttaaaacatggtcgcgtgggcatctatttcggtatgaaagcgccgatgatgcaaaccgaagacgggcaaattgaagagtcttactccatttctgccgggctggatttcccgtccgtcggcccgcaacatgcgtatctcaacagcactggacgcgctgattacgtgtctattaccgacgatgaagccctggaagcctttaaaacgctttgcctgcatgaagggatcatcccggcgctggaatcctcccacgccctggcccatgcgctgaaaatgatgcgcgaaaatccggaaaaagagcagctactggtggttaacctttccggtcgcggcgataaagacatcttcaccgttcacgatattttgaaagcacgaggggaaatctga

SEQ ID NO: 54 - DNA, 807 bp, Artificial Sequence
  Synthetic: trpA
atggaacgctacgaatctctgtttgcccagttgaaggagcgcaaagaaggcgcattcgttcctttcgtcaccctcggtgatccgggcattgagcagtcgttgaaaattatcgatacgctaattgaagccggtgctgacgcgctggagttaggcatccccttctccgacccactggcggatggcccgacgattcaaaacgccacactgcgtgcttttgcggcgggagtaaccccggcgcagtgctttgagatgctggcactcattcgccagaagcacccgaccattcccatcggccttttgatgtatgccaacctggtgtttaacaaaggcattgatgagttttatgccgagtgcgagaaagtcggcgtcgattcggtgctggttgccgatgtgcccgtggaagagtccgcgcccttccgccaggccgcgttgcgtcataatgtcgcacctatctttatttgcccgccgaatgccgacgatgatttgctgcgccagatagcctcttacggtcgtggttacacctatttgctgtcgcgagcgggcgtgaccggcgcagaaaaccgcgccgcgttacccctcaatcatctggttgcgaagctgaaagagtacaacgctgcgcctccattgcagggatttggtatttccgccccggatcaggtaaaagccgcgattgatgcaggagctgcgggcgcgatttctggttcggccatcgttaaaatcatcgagcaacatattaatgagccagagaaaatgctggcggcactgaaagcttttgtacaaccgatgaaagcggcgacgcgcagttaa

SEQ ID NO: 55 - protein, 520 aa, Artificial Sequence
  Synthetic: TrpE
MQTQKPTLELLTCEGAYRDNPTALFHQLCGDRPATLLLESADIDSKDDLKSLLLVDSALRITALSDTVTIQALSGNGEALLTLLDNALPAGVENEQSPNCRVLRFPPVSPLLDEDARLCSLSVFDAFRLLQNLLNVPKEEREAMFFGGLFSYDLVAGFENLPQLSAENSCPDFCFYLAETLMVIDHQKKSTRIQASLFAPNEEEKQRLTARLNELRQQLTEAAPPLPVVSVPHMRCECNQSDEEFGGVVRLLQKAIRAGEIFQVVPSRRFSLPCPSPLAAYYVLKKSNPSPYMFFMQDNDFTLFGASPESSLKYDATSRQIEIYPIAGTRPRGRRADGSLDRDLDSRIELEMRTDHKELSEHLMLVDLARNDLARICTPGSRYVADLTKVDRYSYVMHLVSRVVGELRHDLDALHAYRACMNMGTLSGAPKVRAMQLIAEAEGRRRGSYGGAVGYFTAHGDLDTCIVIRSALVENGIATVQAGAGVVLDSVPQSEADETRNKARAVLRAIATAHHAQETF

SEQ ID NO: 56 - protein, 531 aa, Artificial Sequence
  Synthetic: TrpD
MADILLLDNIDSFTYNLADQLRSNGHNVVIYRNHIPAQTLIERLATMSNPVLMLSPGPGVPSEAGCMPELLTRLRGKLPIIGICLGHQAIVEAYGGYVGQAGEILHGKASSIEHDGQAMFAGLTNPLPVARYHSLVGSNIPAGLTINAHFNGMVMAVRHDADRVCGFQFHPESILTTQGARLLEQTLAWAQQKLEPTNTLQPILEKLYQAQTLSQQESHQLFSAVVRGELKPEQLAAALVSMKIRGEHPNEIAGAATALLENAAPFPRPDYLFADIVGTGGDGSNSINISTASAFVAAACGLKVAKHGNRSVSSKSGSSDLLAAFGINLDMNADKSRQALDELGVCFLFAPKYHTGFRHAMPVRQQLKTRTLFNVLGPLINPAHPPLALIGVYSPELVLPIAETLRVLGYQRAAVVHSGGMDEVSLHAPTIVAELHDGEIKSYQLTAEDFGLTPYHQEQLAGGTPEENRDILTRLLQGKGDAAHEAAVAANVAMLMRLHGHEDLQANAQTVLEVLRSGSAYDRVTALAARG

SEQ ID NO: 57 - protein, 452 aa, Artificial Sequence
  Synthetic: TrpC
MQTVLAKIVADKAIWVETRKEQQPLASFQNEVQPSTRHFYDALQGARTAFILECKKASPSKGVIRDDFDPARIAAIYKHYASAISVLTDEKYFQGSFDFLPIVSQIAPQPILCKDFIIDPYQIYLARYYQADACLLMLSVLDDEQYRQLAAVAHSLEMGVLTEVSNEEELERAIALGAKVVGINNRDLRDLSIDLNRTRELAPKLGHNVTVISESGINTYAQVRELSHFANGFLIGSALMAHDDLNAAVRRVLLGENKVCGLTRGQDAKAAYDAGAIYGGLIFVATSPRCVNVEQAQEVMAAAPLQYVGVFRNHDIADVADKAKVLSLAAVQLHGNEDQLYIDNLREALPAHVAIWKALSVGETLPARDFQHIDKYVFDNGQGGSGQRFDWSLLNGQSLGNVLLAGGLGADNCVEAAQTGCAGLDFNSAVESQPGIKDARLLASVFQTLRAY

SEQ ID NO: 58 - protein, 397 aa, Artificial Sequence
  Synthetic: TrpB
MTTLLNPYFGEFGGMYVPQILMPALRQLEEAFVSAQKDPEFQAQFNDLLKNYAGRPTALTKCQNITAGTNTTLYLKREDLLHGGAHKTNQVLGQALLAKRMGKTEIIAETGAGQHGVASALASALLGLKCRIYMGAKDVERQSPNVFRMRLMGAEVIPVHSGSATLKDACNEALRDWSGSYETAHYMLGTAAGPHPYPTIVREFQRMIGEETKAQILEREGRLPDAVIACVGGGSNAIGMFADFINETDVGLIGVEPGGHGIETGEHGAPLKHGRVGIYFGMKAPMMQTEDGQIEESYSISAGLDFPSVGPQHAYLNSTGRADYVSITDDEALEAFKTLCLHEGIIPALESSHALAHALKMMRENPEKEQLLVVNLSGRGDKDIFTVHDILKARGEI

SEQ ID NO: 59 - protein, 268 aa, Artificial Sequence
  Synthetic: TrpA
MERYESLFAQLKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAECEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPEKMLAALKAFVQPMKAATRS

SEQ ID NO: 60 - protein, 350 aa, Artificial Sequence
  Synthetic: AroGfbr: feedback resistant 2-dehydro-3-deoxyphosphoheptonate aldolase from E. coli
MNYQNDDLRIKEIKELLPPVALLEKFPATENAANTVAHARKAIHKILKGNDDRLLVVIGPCSIHDPVAAKEYATRLLTLREELQDELEIVMRVYFEKPRTTVGWKGLINDPHMDNSFQINDGLRIARKLLLDINDSGLPAAGEFLDMITLQYLADLMSWGAIGARTTESQVHRELASGLSCPVGFKNGTDGTIKVAIDAINAAGAPHCFLSVTKWGHSAIVNTSGNGDCHIILRGGKEPNYSAKHVAEVKEGLNKAGLPAQVMIDFSHANSSKQFKKQMDVCTDVCQQIAGGEKAIIGVMVESHLVEGNQSLESGEPLAYGKSITDACIGWDDTDALLRQLASAVKARRG

SEQ ID NO: 61 - protein, 520 aa, Artificial Sequence
  Synthetic: TrpEfbr: feedback resistant anthranilate synthase component I from E. coli
MQTQKPTLELLTCEGAYRDNPTALFHQLCGDRPATLLLEFADIDSKDDLKSLLLVDSALRITALSDTVTIQALSGNGEALLTLLDNALPAGVENEQSPNCRVLRFPPVSPLLDEDARLCSLSVFDAFRLLQNLLNVPKEEREAMFFGGLFSYDLVAGFENLPQLSAENSCPDFCFYLAETLMVIDHQKKSTRIQASLFAPNEEEKQRLTARLNELRQQLTEAAPPLPVVSVPHMRCECNQSDEEFGGVVRLLQKAIRAGEIFQVVPSRRFSLPCPSPLAAYYVLKKSNPSPYMFFMQDNDFTLFGASPESSLKYDATSRQIEIYPIAGTRPRGRRADGSLDRDLDSRIELEMRTDHKELSEHLMLVDLARNDLARICTPGSRYVADLTKVDRYSYVMHLVSRVVGELRHDLDALHAYRACMNMGTLSGAPKVRAMQLIAEAEGRRRGSYGGAVGYFTAHGDLDTCIVIRSALVENGIATVQAGAGVVLDSVPQSEADETRNKARAVLRAIATAHHAQETF

SEQ ID NO: 62 - protein, 410 aa, Artificial Sequence
  Synthetic: SerA: 2-oxoglutarate reductase from E. coli Nissle
MAKVSLEKDKIKFLLVEGVHQKALESLRAAGYTNIEFHKGALDDEQLKESIRDAHFIGLRSRTHLTEDVINAAEKLVAIGCFCIGTNQVDLDAAAKRGIPVFNAPFSNTRSVAELVIGELLLLLRGVPEANAKAHRGVWNKLAAGSFEARGKKLGIIGYGHIGTQLGILAESLGMYVYFYDIENKLPLGNATQVQHLSDLLNMSDVVSLHVPENPSTKNMMGAKEISLMKPGSLLINASRGTVVDIPALCDALASKHLAGAAIDVFPTEPATNSDPFTSPLCEFDNVLLTPHIGGSTQEAQENIGLEVAGKLIKYSDNGSTLSAVNFPEVSLPLHGGRRLMHIHENRPGVLTALNKIFAEQGVNIAAQYLQTSAQMGYVVIDIEADEDVAEKALQAMKAIPGTIRARLLY

SEQ ID NO: 63 - protein, 410 aa, Artificial Sequence
  Synthetic: SerAfbr: feedback resistant 2-oxoglutarate reductase from E. coli Nissle
MAKVSLEKDKIKFLLVEGVHQKALESLRAAGYTNIEFHKGALDDEQLKESIRDAHFIGLRSRTHLTEDVINAAEKLVAIGCFCIGTNQVDLDAAAKRGIPVFNAPFSNTRSVAELVIGELLLLLRGVPEANAKAHRGVWNKLAAGSFEARGKKLGIIGYGHIGTQLGILAESLGMYVYFYDIENKLPLGNATQVQHLSDLLNMSDVVSLHVPENPSTKNMMGAKEISLMKPGSLLINASRGTVVDIPALCDALASKHLAGAAIDVFPTEPATNSDPFTSPLCEFDNVLLTPHIGGSTQEAQENIGLEVAGKLIKYSDNGSTLSAVNFPEVSLPLHGGRRLMHIAEARPGVLTALNKIFAEQGVNIAAQYLQTSAQMGYVVIDIEADEDVAEKALQAMKAIPGTIRARLLY

SEQ ID NO: 64 - protein, 471 aa, Artificial Sequence
  Synthetic: TnaA: tryptophanase from E. coli
MENFKHLPEPFRIRVIEPVKRTTRAYREEAIIKSGMNPFLLDSEDVFIDLLTDSGTGAVTQSMQAAMMRGDEAYSGSRSYYALAESVKNIFGYQYTIPTHQGRGAEQIYIPVLIKKREQEKGLDRSKMVAFSNYFFDTTQGHSQINGCTVRNVYIKEAFDTGVRYDFKGNFDLEGLERGIEEVGPNNVPYIVATITSNSAGGQPVSLANLKVMYSIAKKYDIPVVMDSARFAENAYFIKQREAEYKDWTIEQITRETYKYADMLAMSAKKDAMVPMGGLLCMKDDSFFDVYTECRTLCVVQEGFPTYGGLEGGAMERLAVGLYDGMNLDWLAYRIAQVQYLVDGLEEIGVVCQQAGGHAAFVDAGKLLPHIPADQFPAQALACELYKVAGIRAVEIGSFLLGRDPKTGKQLPCPAELLRLTIPRATYTQTHMDFIIEAFKHVKENAANIKGLTFTYEPKVLRHFTAKLKEV

SEQ ID NO: 65 - protein, 416 aa, Artificial Sequence
  Synthetic: Pseudomonas kynureninase, P83788
MTTRNDCLALDAQDSLAPLRQQFALPEGVIYLDGNSLGARPVAALARAQAVIAEEWGNGLIRSWNSAGWRDLSERLGNRLATLIGARDGEVVVTDTTSINLFKVLSAALRVQATRSPERRVIVTETSNFPTDLYIAEGLADMLQQGYTLRLVDSPEELPQAIDQDTAVVMLTHVNYKTGYMHDMQALTALSHECGALAIWDLAHSAGAVPVDLHQAGADYAIGCTYKYLNGGPGSQAFVWVSPQLCDLVPQPLSGWFGHSRQFAMEPRYEPSNGIARYLCGTQPITSLAMVECGLDVFAQTDMASLRRKSLALTDLFIELVEQRCAAHELTLVTPREHAKRGSHVSFEHPEGYAVIQALIDRGVIGDYREPRIMRFGFTPLYTTFTEVWDAVQILGEILDRKTWAQAQFQVRHSVT

SEQ ID NO: 66 - protein, 465 aa, Artificial Sequence
  Synthetic: Human, Q16719
MEPSSLELPADTVQRIAAELKCHPTDERVALHLDEEDKLRHFRECFYIPKIQDLPPVDLSLVNKDENAIYFLGNSLGLQPKMVKTYLEEELDKWAKIAAYGHEVGKRPWITGDESIVGLMKDIVGANEKEIALMNALTVNLHLLMLSFFKPTPKRYKILLEAKAFPSDHYAIESQLQLHGLNIEESMRMIKPREGEETLRIEDILEVIEKEGDSIAVILFSGVHFYTGQHFNIPAITKAGQAKGCYVGFDLAHAVGNVELYLHDWGVDFACWCSYKYLNAGAGGIAGAFIHEKHAHTIKPALVGWFGHELSTRFKMDNKLQLIPGVCGFRISNPPILLVCSLHASLEIFKQATMKALRKKSVLLTGYLEYLIKHNYGKDKAATKKPVVNIITPSHVEERGCQLTITFSVPNKDVFQELEKRGVVCDKRNPNGIRVAPVPLYNSFHDVYKFTNLLTSILDSAETKN

SEQ ID NO: 67 - protein, 378 aa, Artificial Sequence
  Synthetic: Shewanella, Q8E973
MLLNVKQDFCLAGPGYLLNHSVGRPLKSTEQALKQAFFAPWQESGREPWGQWLGVIDNFTAALASLFNGQPQDFCPQVNLSSALTKIVMSLDRLTRDLTRNGGAVVLMSEIDFPSMGFALKKALPASCELRFIPKSLDVTDPNVWDAHICDDVDLVFVSHAYSNTGQQAPLAQIISLARERGCLSLVDVAQSAGILPLDLAKLQPDFMIGSSVKWLCSGPGAAYLWVNPAILPECQPQDVGWFSHENPFEFDIHDFRYHPTALRFWGGTPSIAPYAIAAHSIEYFANIGSQVMREHNLQLMEPVVQALDNELVSPQEVDKRSGTIILQFGERQPQILAALAAANISVDTRSLGIRVSPHIYNDEADIARLLGVIKANR

SEQ ID NO: 68 - DNA, 1303 bp, Artificial Sequence
  Synthetic: kynU (Pseudomonas)
atgacgacccgaaatgattgcctagcgttggatgcacaggacagtctggctccgctgcgccaacaatttgcgctgccggagggtgtgatatacctggatggcaattcgctgggcgcacgtccggtagctgcgctggctcgcgcgcaggctgtgatcgcagaagaatggggcaacgggttgatccgttcatggaactctgcgggctggcgtgatctgtctgaacgcctgggtaatcgcctggctaccctgattggtgcgcgcgatggggaagtagttgttactgataccacctcgattaatctgtttaaagtgctgtcagcggcgctgcgcgtgcaagctacccgtagcccggagcgccgtgttatcgtgactgagacctcgaatttcccgaccgacctgtatattgcggaagggttggcggatatgctgcaacaaggttacactctgcgtttggtggattcaccggaagagctgccacaggctatagatcaggacaccgcggtggtgatgctgacgcacgtaaattataaaaccggttatatgcacgacatgcaggctctgaccgcgttgagccacgagtgtggggctctggcgatttgggatctggcgcactctgctggcgctgtgccggtggacctgcaccaagcgggcgcggactatgcgattggctgcacgtacaaatacctgaatggcggcccgggttcgcaagcgtttgtttgggtttcgccgcaactgtgcgacctggtaccgcagccgctgtctggttggttcggccatagtcgccaattcgcgatggagccgcgctacgaaccttctaacggcattgctcgctatctgtgcggcactcagcctattactagcttggctatggtggagtgcggcctggatgtgtttgcgcagacggatatggcttcgctgcgccgtaaaagtctggcgctgactgatctgttcatcgagctggttgaacaacgctgcgctgcacacgaactgaccctggttactccacgtgaacacgcgaaacgcggctctcacgtgtcttttgaacaccccgagggttacgctgttattcaagctctgattgatcgtggcgtgatcggcgattaccgtgagccacgtattatgcgtttcggtttcactcctctgtatactacttttacggaagtttgggatgcagtacaaatcctgggcgaaatcctggatcgtaagacttgggcgcaggctcagtttcaggtgcgccactctgttacttaaaaataaaacgaaaggctcagtcgaaagactgggcctttcgttttatctgttg

SEQ ID NO: 69 - DNA, 1450 bp, Artificial Sequence
  Synthetic: kynU(Human)
atggagccttcatctttagaactgccagcggacacggtgcagcgcatcgcggcggaactgaagtgccatccgactgatgagcgtgtggcgctgcatctggacgaagaagataaactgcgccactttcgtgaatgtttttatattcctaaaattcaagacttgccgccggtagatttgagtctcgttaacaaagatgaaaacgcgatctactttctgggcaactctctgggtctgcaaccaaaaatggttaaaacgtacctggaggaagaactggataaatgggcaaaaatcgcggcttatggtcacgaagtgggcaagcgtccttggattactggcgacgagtctattgtgggtttgatgaaagatattgtgggcgcgaatgaaaaggaaattgcactgatgaatgctctgaccgttaatctgcacctgctgatgctgtctttttttaaaccgaccccgaaacgctacaaaatactgctggaagcgaaagcgtttccgtcggatcactatgctatagaaagtcaactgcagttgcatggtctgaatatcgaggaatctatgcgcatgattaaaccgcgtgagggtgaagaaacgctgcgtattgaagacattctggaagttattgaaaaagaaggtgattctatcgcagttatactgttttctggcgtgcacttttatacaggtcagcacttcaatatcccggcaatcactaaagcggggcaggcaaaaggctgctatgttggttttgacctggcgcatgcagtggggaatgttgaactgtatctgcacgattggggcgttgatttcgcgtgttggtgtagctacaaatatctgaacgctggcgcgggtggcattgctggcgcttttattcacgaaaaacacgcgcacaccattaaaccggctctggttggctggttcggtcatgagctgagtactcgctttaaaatggataacaaactgcaattgattccgggtgtttgcggcttccgtatcagcaatccgccgattctgctggtttgcagcctgcacgctagtctggaaatctttaagcaggcgactatgaaagcgctgcgcaaaaaatctgtgctgctgaccggctatctggagtatctgatcaaacacaattatggcaaagataaagctgcaactaaaaaaccggtagtgaacattatcaccccctcacacgtggaggagcgcggttgtcagctgactattactttcagtgtacctaataaagatgtgttccaggaactggaaaaacgcggcgttgtttgtgataaacgtaacccgaatggtattcgcgtggctcctgtgccgctgtacaattcattccacgatgtttataaattcaccaacctgctgacttctattctcgacagtgctgagactaaaaattaaaaataaaacgaaaggctcagtcgaaagactgggcctttcgttttatctgttg

SEQ ID NO: 70 - DNA, 1189 bp, Artificial Sequence
  Synthetic: kynU(Shewanella)
atgctgctgaatgtaaaacaggacttttgcctggcaggcccgggctacctgctgaatcactcggttggccgtccgctgaaatcaactgagcaagcgctgaaacaagcattttttgctccgtggcaagagagcggtcgtgaaccgtggggccagtggctgggtgttattgataatttcactgctgcgctggcatctctgtttaatggtcaaccgcaggatttttgtccgcaggttaacctgagcagcgcgctgactaaaattgtgatgtcactggatcgtctgactcgcgatctgacccgcaatggcggtgctgttgtgctgatgtctgaaatcgatttcccatctatgggcttcgcgttgaaaaaagcgctgccagcgagctgcgaactgcgttttatcccgaaaagtctggacgtgactgatccgaacgtatgggatgcacacatctgtgatgatgtagacctggtttttgtgtctcacgcctatagtaatacgggccaacaggctccgctggcgcaaatcatctctctggcgcgtgaacgtggctgcctgtcactggtggatgtagcgcaatcagcggggattttgccgctggatctggcgaaactgcaaccggacttcatgatcggcagttcggttaaatggctgtgctcgggccctggtgcggcatatctgtgggttaatccggcgattctgccggaatgtcagccgcaggatgtgggctggttttcacatgagaatccctttgaattcgacatccacgatttccgctaccacccgactgcactgcgcttttggggtggtacgccgtcgatcgcgccttatgcgatcgcggcgcactcgatcgaatattttgccaatatcggctcgcaagtgatgcgtgaacacaacctgcaactgatggaaccggtggttcaggcgctggacaatgaactggtgagcccgcaggaagtggataaacgctcaggcactattattctgcaattcggtgaacgtcaaccgcaaattctggcggctctggctgcggcgaacatttcggtggacactcgttctttggggattcgtgttagtccgcacatttataatgatgaggcggacattgcgcgcctgctgggtgtgatcaaagcaaatcgctaaaaataaaacgaaaggctcagtcgaaagactgggcctttcgttttatctgttg

SEQ ID NO: 71 - DNA, 1242 bp, Artificial Sequence
  Synthetic: nupC (polynucleotide)
gtgcacggaaatttaacctgcctcatatttggagcaaatatggaccgcgtccttcattttgtactggcacttgccgttgttgcgattctcgcactgctggtaagcagcgaccgcaaaaaaattcgtatccgttatgttattcaactgcttgttatcgaagtgttactggcgtggttcttcctgaactccgacgttggtctgggcttcgtgaaaggcttctccgaaatgttcgaaaaactgctcggttttgccaacgaagggactaacttcgtctttggtagcatgaatgatcaaggcctggcattcttcttcctgaaagtgctgtgcccaatcgtctttatctctgcgctgatcggtattctccagcatattcgcgtattgccggtgattatccgcgcaattggtttcctgctctccaaagtcaacggcatgggcaaactggaatcctttaacgccgtcagctccctgattctgggtcagtctgaaaactttattgcctataaagatatcctcggcaaaatctcccgcaatcgtatgtacaccatggcagcaacggcgatgtccaccgtgtcgatgtccatcgttggtgcatatatgaccatgctggagccgaaatacgtcgttgcggcgctggtactgaacatgttcagcacctttatcgtgctgtcgctgatcaacccttaccgtgttgatgccagtgaagaaaacattcagatgtccaacctgcacgaaggtcagagcttcttcgaaatgctgggtgaatacattctggcaggtttcaaagttgccattatcgttgccgcgatgctgatcggctttatcgccctgatcgctgcactgaacgctctgtttgctaccgtgactggctggtttggctacagcatctccttccagggcatcctgggttacatcttctatccgattgcatgggtgatgggtgttccttccagtgaagcactgcaagtgggcagtatcatggcgaccaaactggtttccaacgagttcgttgcgatgatggatctgcagaaaattgcttccacgctctctccgcgtgcggaaggcatcatctctgtgttcctggtttccttcgctaacttctcttcaatcgggattatcgcgggtgcggttaaaggcctgaatgaagagcaaggtaacgtggtttctcgcttcggtctgaaactggtttacggctctaccctggtgagtgtgctgtctgcgtcaatcgcagcactggtgctgtaa

SEQ ID NO: 72 - DNA, 2259 bp, Artificial Sequence
  Synthetic: xdhA
atgcgcgtcgatgccattgctaaggtcaccgggcgggcacgatatactgacgattatattatggcgggcatgtgttacgcgaaatatgtacgtagccctatcgcacatggttatgctgtaaatattaatgatgaacaagccaggagtttgccgggcgtcctggcgatttttacctgggaagatgtgccagaaatcccattcgccacggcagggcatgcctggacacttgacgaaaacaagcgcgataccgccgatcgtgccctgctaacgcgtcatgttcgtcatcatggtgacgccgttgccatcgtcgtggcccgcgatgaactcacggcagaaaaagcggcgcaattggtcagcattgagtggcaagaattacccgttatcacctcgccagaagcggcgctggcagaagacgctgcaccaatccataacggtggcaatttactgaaacaaagcacgatgtcgacgggtaatgtccaacaaacaatcgatgccgccgactaccaggtacaggggcactatcagactcccgttattcaacattgtcatatggaaagcgtgacatcgctggcatggatggaggatgactcgcgaattaccatcgtttccagcacccagatcccgcacattgttcgccgcgtggttggtcaggcgctggatattccctggtcatgcgtacgagtcatcaaaccgtttatcggtggcggttttggtaataaacaggatgtactggaagagccaatggcggcattcctgaccagcaaacttggcggcattccggtgaaagtttcccttagccgtgaagagtgtttcctcgcaacccgtacccgccacgcttttactattgacgggcaaatgggcgtgaaccgcgacggaacattgaaaggttatagtctggatgttctgtctaacaccggcgcttatgcatctcacgggcactccattgcttctgctggggggaataaagtcgcttacctttatcctcgttgtgcctacgcttacagttcaaagacctgctataccaacctcccctcggctggtgcgatgcgtggttatggcgcgccacaagtcgtatttgccgttgagtctatgcttgatgatgccgcgacagcgttaggtattgatcctgttgaaattcgtttacgcaacgccgcccgcgaaggagatgctaatccgctcacgggaaaacgtatttacagcgcagggttgccggagtgtcttgaaaaaggccggaaaatctttgaatgggaaaaacgccgtgcagagtgccagaaccagcaaggcaatttacgtcgtggcgttggcgtcgcctgttttagctacacctctaacacctggcctgtcggcgtagaaatagcaggcgcgcgcctgttgatgaatcaggatggaaccatcaacgtgcaaagcggcgcgacggaaatcggccagggtgccgacaccgtgttctcgcaaatggtggcagaaaccgtgggagttccggtcagcgatgttcacgttatttcaacccaagataccgacgttacaccattcgaccccggcgcatttgcctcacgtcagagctatgttgccgcgcctgcgctgcgcagtgcagcactgttattaaaagagaaaatcatcgctcacgccgcagtcatgctacatcagtcagcgatgaatctgaccctgataaaaggccatatcgtgctgattgaaagaccggaagaaccgttaatgtcgttaaaagatttggcgatggacgctttctaccaccctgaacgcggcgggcagctctctgccgaaagctccatcaaaaccaccactaacccaccggcgtttggctgtacctttgttgatctgacggtcgatattgcactgtgcaaagtcaccatcaaccgcatcctcaacgttcatgattcgggccatattcttaatccgctgctggcagaaggtcaggtacacggcggaatgggaatgggcattggctgggcgctatttgaagagatgatcatcgatgcgaaaagcggcgtggtccgtaaccccaatctgctggattacaaaatgccgaccatgccggatctgccacaactggaaagcgcgttcgtcgaaatcaatgagccgcaatcagcatacggacataagtcactgggtgagccccccataattcctgtagccgctgctattcgtaacgcggtgaagatggctaccggtgttgcaatcaatacactgccgctaacgccaaaacgattatatgaagaattccatctggcaggattgatttga

SEQ ID NO: 73 - DNA, 879 bp, Artificial Sequence
  Synthetic: xdhB
atgtttgattttgcttcttaccatcgcgcaaccacccttgccgatgccatcaccctgctggctgacaatccgcaggccaaattgcttgccggtggcactgacgtactgatacagcttcaccatcacaatgaccgctatcgccatattgttgatatccacaatctggcagagcttcagggaataacacaggcggaagatggcgcgctgcgaatcggctctgcgacaacatttactcagctcattgaagatcccgtaatccaacgcaatctcccggcgttatgtgctgcggctgcatcaatcgccgggccgcagatccgtaatgtcgccacctacggcggaaatatttgcaacggtgccaccagcgcagattctgccacgccaacgctaatttatgacgcgaaactggagctccactccccacgcggtgttcgtttcgtcccgattaatggctttcacaccgggccgggcaaagtgtctcttgagcatgacgaaatccttgtcgcctttcattttccgccacagccgaaagaacacgcgggcagcgcgcattttaaatatgccatgcgcgacgcaatggatatttcaacaattggctgcgccgcacattgccgactggataacggcaatttcagcgaattacgcctggcatttggtgttgccgcgccaacgccgattcgctgccaacatgccgaacagactgcacaaaatgcgccattaaacctgcaaacgctggaagccatcagcgaatcagtcctgcaagatgtcgccccgcgttcttcatggcgggccagtaaagagtttcgtctgcatctcatccagacgatgaccaaaaaagtgattagcgaagccgtcgccgcggcggggggaaaattgcaatga

SEQ ID NO: 74 - DNA, 480 bp, Artificial Sequence
  Synthetic: xdhC
atgaatcacagcgaaacaattaccatcgaatgcaccattaacgggatgccttttcagcttcacgccgcgccaggaatgccgctttcggaactactccgagaacaagggcttcttagtgtcaaacaaggttgctgcgtaggcgaatgcggtgcctgtacggtgctggtcgacggcactgcgatagacagttgcttattccttgcgacctgggctgaaggaaaagagatccgcacgctggaaggtgaagcgaaaggcggtaaactttctcatgtccaactggcttatgcgaaatctggtgcagtgcaatgcgggttttgtacgccgggcctgattatggctaccacggcgatgctggcaaaaccacgcgaaaaaccattaaccattacggaaattcgtcgtggactggcgggaaatctttgtcgctgcacggggtatcagatgattgtaaatacagttctggattgcgagaaaacgaagtaa

SEQ ID NO: 75 - DNA, 1002 bp, Artificial Sequence
  Synthetic: Add
atgattgataccaccctgccattaactgatatccatcgccaccttgatggcaacattcgtccccagaccattcttgaacttggccgccagtataatatctcgcttcctgcacaatccctggaaacactgattccccacgttcaggtcattgccaacgaacccgatctggtgagctttctgactaaacttgactggggcgttaaagttctcgcctctcttgatgcctgccgccgcgtggcatttgaaaacattgaagatgcagcccgtaacggcctgcactatgtcgagctgcgtttttcaccaggctacatggcaatggcacatcagctgcctgtagcgggtgttgtcgaagcggtgatcgatggcgtacgtgaaggttgccgcacctttggtgtgcaggcgaagcttatcggtattatgagccggaccttcggcgaagccgcctgtcagcaagagctggaggcctttttagcccaccgtgaccagattaccgcacttgatttagccggtgatgaacttggtttcccgggaagtctgttcctttctcatttcaaccgcgcgcgtgatgcgggctggcatattaccgtccatgcaggcgaagctgccggaccggaaagcatctggcaggcgattcgtgaactgggggcggagcgtattggacatggcgtaaaagccattgaagatcgggcgctgatggattttctcgccgagcaacaaattggtattgaatcctgtctgacctccaatattcagaccagcaccgtggcggatctggctgcacatccgctgaaaacgttccttgagcatggcattcgtgccagcattaacactgacgatccaggcgtgcagggagtggatatcattcacgaatataccgttgccgcgccagctgctgggttatcccgcgagcaaatccgccaggcacagattaatggtctggaaatggctttcctcagcgcagaggaaaaacgcgcactgcgagaaaaagtcgccgcgaagtaa

SEQ ID NO: 76 - DNA, 834 bp, Artificial Sequence
  Synthetic: xapA
atgtatcaggctcagttttctcataacccactgtattgcgtagatattatcaagacttataaacctgatttcacgccacgagtggcctttattttaggttccgggctgggcgcgctggccgatcagattgagaacgcggtcgcaatttcctacgaaaagctgcctgggttcccggtaagtaccgtacacggtcatgcgggtgagctggtgctgggttatctccagggggtgccagtggcgtgtatgaaaggtcgcggacatttctacgaaggtcgtgggatgaccatcatgacggatgcaatccgtacctttaagttgctgggctgcgagttgctgttctgcaccaatgcggctggctcactgcgccctgaagtgggggccggcagtctggtcgcattgaaagatcacatcaacaccatgccgggaacgccgatggtgggtcttaatgatgaacgttttggtgagcgcttcttctcgctggcgaatgcctacgatgcggaataccgcgcactgttacaaaaagtggcgaaagaagaggggttccctctgacggagggcgtgttcgtctcatatccggggccgaatttcgagactgcggcggaaattcgcatgatgcaaattattggtggggatgttgttggtatgtctgtggtgcctgaggttatttcagctcgccattgcgaacttaaagtcgttgcggtctctgcgattaccaacatggcggaaggtctgagtgacgtgaagctttctcatgcccaaacgctggcagcagcggaactctcaaagcaaaactttattaatcttatttgcggctttctgcgcaaaattgcctga

SEQ ID NO: 77 - DNA, 720 bp, Artificial Sequence
  Synthetic: deoD
atggctaccccacacattaatgcagaaatgggcgatttcgctgacgtagttttgatgccaggcgacccgctgcgtgcgaagtatattgctgaaactttccttgaagatgcccgtgaagtgaacaacgttcgcggtatgctgggcttcaccggtacttacaaaggccgcaaaatttccgtaatgggtcacggtatgggtatcccgtcctgctccatctacaccaaagaactgatcaccgatttcggcgtgaagaaaattatccgcgtgggttcctgtggcgcagttctgccgcacgtaaaactacgcgacgtcgttatcggtatgggtgcctgcaccgattccaaagttaaccgcatccgttttaaagaccatgactttgccgctatcgctgactttgacatggtgcgtaacgcggtagacgcggctaaagcactgggcgttgatgctcgcgtgggtaacctgttctccgctgacctgttctactctccggacggcgaaatgttcgacgtgatggaaaaatacggcatcctcggcgtggaaatggaagcggctggtatctacggcgtcgctgcagaatttggcgcgaaagccctgaccatctgcaccgtgtctgaccacatccgcactcacgagcagaccactgccgctgagcgtcagaccaccttcaacgacatgatcaaaatcgcactggaatccgttctgctgggcgataaagagtaa

SEQ ID NO: 78 - protein, 413 aa, Artificial Sequence
  Synthetic: NupC (polypeptide)
VHGNLTCLIFGANMDRVLHFVLALAVVAILALLVSSDRKKIRIRYVIQLLVIEVLLAWFFLNSDVGLGFVKGFSEMFEKLLGFANEGTNFVFGSMNDQGLAFFFLKVLCPIVFISALIGILQHIRVLPVIIRAIGFLLSKVNGMGKLESFNAVSSLILGQSENFIAYKDILGKISRNRMYTMAATAMSTVSMSIVGAYMTMLEPKYVVAALVLNMFSTFIVLSLINPYRVDASEENIQMSNLHEGQSFFEMLGEYILAGFKVAIIVAAMLIGFIALIAALNALFATVTGWFGYSISFQGILGYIFYPIAWVMGVPSSEALQVGSIMATKLVSNEFVAMMDLQKIASTLSPRAEGIISVFLVSFANFSSIGIIAGAVKGLNEEQGNVVSRFGLKLVYGSTLVSVLSASIAALVL

SEQ ID NO: 79 - protein, 752 aa, Artificial Sequence
  Synthetic: xdhA (polypeptide)
MRVDAIAKVTGRARYTDDYIMAGMCYAKYVRSPIAHGYAVNINDEQARSLPGVLAIFTWEDVPEIPFATAGHAWTLDENKRDTADRALLTRHVRHHGDAVAIVVARDELTAEKAAQLVSIEWQELPVITSPEAALAEDAAPIHNGGNLLKQSTMSTGNVQQTIDAADYQVQGHYQTPVIQHCHMESVTSLAWMEDDSRITIVSSTQIPHIVRRVVGQALDIPWSCVRVIKPFIGGGFGNKQDVLEEPMAAFLTSKLGGIPVKVSLSREECFLATRTRHAFTIDGQMGVNRDGTLKGYSLDVLSNTGAYASHGHSIASAGGNKVAYLYPRCAYAYSSKTCYTNLPSAGAMRGYGAPQVVFAVESMLDDAATALGIDPVEIRLRNAAREGDANPLTGKRIYSAGLPECLEKGRKIFEWEKRRAECQNQQGNLRRGVGVACFSYTSNTWPVGVEIAGARLLMNQDGTINVQSGATEIGQGADTVFSQMVAETVGVPVSDVHVISTQDTDVTPFDPGAFASRQSYVAAPALRSAALLLKEKIIAHAAVMLHQSAMNLTLIKGHIVLIERPEEPLMSLKDLAMDAFYHPERGGQLSAESSIKTTTNPPAFGCTFVDLTVDIALCKVTINRILNVHDSGHILNPLLAEGQVHGGMGMGIGWALFEEMIIDAKSGVVRNPNLLDYKMPTMPDLPQLESAFVEINEPQSAYGHKSLGEPPIIPVAAAIRNAVKMATGVAINTLPLTPKRLYEEFHLAGLI

SEQ ID NO: 80 - protein, 292 aa, Artificial Sequence
  Synthetic: xdhB (polypeptide)
MFDFASYHRATTLADAITLLADNPQAKLLAGGTDVLIQLHHHNDRYRHIVDIHNLAELQGITQAEDGALRIGSATTFTQLIEDPVIQRNLPALCAAAASIAGPQIRNVATYGGNICNGATSADSATPTLIYDAKLELHSPRGVRFVPINGFHTGPGKVSLEHDEILVAFHFPPQPKEHAGSAHFKYAMRDAMDISTIGCAAHCRLDNGNFSELRLAFGVAAPTPIRCQHAEQTAQNAPLNLQTLEAISESVLQDVAPRSSWRASKEFRLHLIQTMTKKVISEAVAAAGGKLQ

SEQ ID NO: 81 - protein, 292 aa, Artificial Sequence; identical to SEQ ID NO: 80
  Synthetic: xdhC (polypeptide)

SEQ ID NO: 82 - protein, 333 aa, Artificial Sequence
  Synthetic: Add (polypeptide)
MIDTTLPLTDIHRHLDGNIRPQTILELGRQYNISLPAQSLETLIPHVQVIANEPDLVSFLTKLDWGVKVLASLDACRRVAFENIEDAARNGLHYVELRFSPGYMAMAHQLPVAGVVEAVIDGVREGCRTFGVQAKLIGIMSRTFGEAACQQELEAFLAHRDQITALDLAGDELGFPGSLFLSHFNRARDAGWHITVHAGEAAGPESIWQAIRELGAERIGHGVKAIEDRALMDFLAEQQIGIESCLTSNIQTSTVADLAAHPLKTFLEHGIRASINTDDPGVQGVDIIHEYTVAAPAAGLSREQIRQAQINGLEMAFLSAEEKRALREKVAAK

SEQ ID NO: 83 - protein, 277 aa, Artificial Sequence
  Synthetic: xapA (polypeptide)
MYQAQFSHNPLYCVDIIKTYKPDFTPRVAFILGSGLGALADQIENAVAISYEKLPGFPVSTVHGHAGELVLGYLQGVPVACMKGRGHFYEGRGMTIMTDAIRTFKLLGCELLFCTNAAGSLRPEVGAGSLVALKDHINTMPGTPMVGLNDERFGERFFSLANAYDAEYRALLQKVAKEEGFPLTEGVFVSYPGPNFETAAEIRMMQIIGGDVVGMSVVPEVISARHCELKVVAVSAITNMAEGLSDVKLSHAQTLAAAELSKQNFINLICGFLRKIA

SEQ ID NO: 84 - protein, 239 aa, Artificial Sequence
  Synthetic: deoD (polypeptide)
MATPHINAEMGDFADVVLMPGDPLRAKYIAETFLEDAREVNNVRGMLGFTGTYKGRKISVMGHGMGIPSCSIYTKELITDFGVKKIIRVGSCGAVLPHVKLRDVVIGMGACTDSKVNRIRFKDHDFAAIADFDMVRNAVDAAKALGVDARVGNLFSADLFYSPDGEMFDVMEKYGILGVEMEAAGIYGVAAEFGAKALTICTVSDHIRTHEQTTAAERQTTFNDMIKIALESVLLGDKE

SEQ ID NO: 85 - DNA, 60 bp, Artificial Sequence
  Synthetic: argA WT
gcaaaaaaacagaataaaaatacaataatttcgaataatcatgcaaagaggtgtaccgtg

SEQ ID NO: 86 - DNA, 60 bp, Artificial Sequence
  Synthetic: argA mutant
gcaaaaaaacactttaaaaacttaataatttcctttaatcacttaaagaggtgtaccgtg

SEQ ID NO: 87 - DNA, 76 bp, Artificial Sequence
  Synthetic: argI WT
agacttgcaaatgaataatcatccatatagattgaattttaattcattaaggcgttagccacaggagggatctatg

SEQ ID NO: 88 - DNA, 76 bp, Artificial Sequence
  Synthetic: argI mutant
agacttgcaaacttatacttatccatatagattttgttttaatttgttaaggcgttagccacaggagggatctatg

SEQ ID NO: 89 - DNA, 160 bp, Artificial Sequence
  Synthetic: argCBH WT
tcattgttgacacacctctggtcatgatagtatcaatattcatgcagtatttatgaataaaaatacactaacgttgagcgtaataaaacccaccagccgtaaggtgaatgttttacgtttaacctggcaaccagacataagaaggtgaatagccccgatg

SEQ ID NO: 90 - DNA, 160 bp, Artificial Sequence
  Synthetic: argCBH mutant
tcattgttgacacacctctggtcatgatagtatcaaacttcatgggatatttatctttaaaaatacttgaacgttgagcgtaataaaacccaccagccgtaaggtgaatgttttacgtttaacctggcaaccagacataagaaggtgaatagccccgatg

SEQ ID NO: 91 - DNA, 160 bp, Artificial Sequence
  Synthetic: argE WT
catcggggctattcaccttcttatgtctggttgccaggttaaacgtaaaacattcaccttacggctggtgggttttattacgctcaacgttagtgtatttttattcataaatactgcatgaatattgatactatcatgaccagaggtgtgtcaacaatga

SEQ ID NO: 92 - DNA, 160 bp, Artificial Sequence
  Synthetic: argE mutant
catcggggctattcaccttcttatgtctggttgccaggttaaacgtaaaacattcaccttacggctggtgggttttattacgctcaacgttcaagtatttttaaagataaatatcccatgaagtttgatactatcatgaccagaggtgtgtcaacaatga

SEQ ID NO: 93 - DNA, 81 bp, Artificial Sequence
  Synthetic: carAB WT
agcagatttgcattgatttacgtcatcattgtgaattaatatgcaaataaagtgagtgaatattctctggagggtgttttg

SEQ ID NO: 94 - DNA, 81 bp, Artificial Sequence
  Synthetic: carAB mutant
agcagatttgcattgatttacgtcatcattgtcttttaatatcttaataactggagtgacgtttctctggagggtgttttg

SEQ ID NO: 95 - DNA, 88 bp, Artificial Sequence
  Synthetic: argD WT
tttctgattgccattcagtgattttttatgcatattttgtgattataatttcatatttatttatgcgtaacagggtgatcatgagatg

SEQ ID NO: 96 - DNA, 88 bp, Artificial Sequence
  Synthetic: argD mutant
tttctgattgccattcagtctttttttacttatattttgtctttataatcttatatttatttatgcgtaacagggtgatcatgagatg

SEQ ID NO: 97 - DNA, 219 bp, Artificial Sequence
  Synthetic: argG WT
ctaatcacgtgaatgaatatccagttcactttcatttgttgaatacttttaccttctcctgctttcccttaagcgcattattttacaaaaaacacactaaactcttcctgtctccgataaaagatgattaaatgaaaactcatttattttgcataaaaattcagtgaaagcagaaatccaggctcatcatcagttaattaagcagggtgttattttatg

SEQ ID NO: 98 - DNA, 219 bp, Artificial Sequence
  Synthetic: argG mutant
ctaatcaccttaatgaatcttcagttcactttcatttgttgaatacttttaccttctcctgctttcccttaagcgcattattttacaaaaaacacactaaactcttcctgtctccgataaaagatgatcttatgaaaacctttttatttcttataaaaatcttgtgaaagcagaaatccaggctcatcatcagttaattaagcagggtgttattttatg

SEQ ID NO: 99 - DNA, 233 bp, Artificial Sequence
  Synthetic: argG mutant
cctgaaacgtggcaaattctactcgttttgggtaaaaaatgcaaatactgctgggatttggtgtaccgagacgggacgtaaaatctgcaggcattatagtgatccacgccacattttgtcaacgtttattgctaatcattgacggctagctcagtcctaggtacagtgctagcacccgtttttttgggctagaaataattttgtttaactttaagaaggagatatacataccc

SEQ ID NO: 100 - DNA, 1053 bp, Artificial Sequence
  Synthetic: Wild-type argG
gtgatccacgccacattttgtcaacgtttattgctaatcacgtgaatgaatatccagttcactttcatttgttgaatacttttaccttctcctgctttcccttaagcgcattattttacaaaaaacacactaaactcttcctgtctccgataaaagatgattaaatgaaaactcatttattttgcataaaaattcagtgaaagcagaaatccaggctcatcatcagttaattaagcagggtgttattttatgacgacgattctcaagcatctcccggtaggtcaacgtattggtatcgctttttccggcggtctggacaccagtgccgcactgctgtggatgcgacaaaagggagcggttccttatgcatatactgcaaacctgggccagccagacgaagaggattatgatgcgatccctcgtcgtgccatggaatacggcgcggagaacgcacgtctgatcgactgccgcaaacaactggtggccgaaggtattgccgctattcagtgtggcgcatttcataacaccactggtggactgacctatttcaacacgacgccgctgggccgcgccgtgaccggcaccatgctggttgctgctatgaaagaagatggcgtgaatatctggggtgacggcagcacctataaaggaaacgatatcgaacgtttctaccgttacggtctgctgaccaatgctgaactgcagatttacaaaccgtggcttgatactgactttattgatgaactgggtggccgtcatgagatgtctgaatttatgattgcctgcggtttcgactacaaaatgtctgtcgaaaaagcttactccacggactccaacatgcttggtgcaacgcatgaagcgaaggatctggaatacctcaactccagcgtcaaaatcgtcaacccaattatgggcgtgaagttttgggatgagagcgtgaaaatcccggcagaagaagtcacagtacgctttgagcaaggtcatccggtggcgctgaacggtaaaacctttagcgacgacgtagaaatgatgctggaagctaaccgcatcggc

SEQ ID NO: 101 - DNA, 734 bp, Artificial Sequence
  Synthetic: Constitutive argG
ttgacggctagctcagtcctaggtacagtgctagcacccgtttttttgggctagaaataattttgtttaactttaagaaggagatatacatacccatgacgacgattctcaagcatctcccggtaggtcaacgtattggtatcgctttttccggcggtctggacaccagtgccgcactgctgtggatgcgacaaaagggagcggttccttatgcatatactgcaaacctgggccagccagacgaagaggattatgatgcgatccctcgtcgtgccatggaatacggcgcggagaacgcacgtctgatcgactgccgcaaacaactggtggccgaaggtattgccgctattcagtgtggcgcatttcataacaccactggtggactgacctatttcaacacgacgccgctgggccgcgccgtgaccggcaccatgctggttgctgctatgaaagaagatggcgtgaatatctggggtgacggcagcacctataaaggaaacgatatcgaacgtttctaccgttacggtctgctgaccaatgctgaactgcagatttacaaaccgtggcttgatactgactttattgatgaactgggtggccgtcatgagatgtctgaatttatgattgcctgcggtttcgactacaaaatgtctgtcgaaaaagcttactccacggactccaacatgcttggtgcaacgcatgaagcgaaggatctggaatacctcaactccagc

SEQ ID NO: 102 - DNA, 1332 bp, Artificial Sequence
  Synthetic: Nucleotide sequence of exemplary argAfbr sequence
atggtaaaggaacgtaaaaccgagttggtcgagggattccgccattcggttccctgtatcaatacccaccggggaaaaacgtttgtcatcatgctcggcggtgaagccattgagcatgagaatttctccagtatcgttaatgatatcgggttgttgcacagcctcggcatccgtctggtggtggtctatggcgcacgtccgcagatcgacgcaaatctggctgcgcatcaccacgaaccgctgtatcacaagaatatacgtgtgaccgacgccaaaacactggaactggtgaagcaggctgcgggaacattgcaactggatattactgctcgcctgtcgatgagtctcaataacacgccgctgcagggcgcgcatatcaacgtcgtcagtggcaattttattattgcccagccgctgggcgtcgatgacggcgtggattactgccatagcgggcgtatccggcggattgatgaagacgcgatccatcgtcaactggacagcggtgcaatagtgctaatggggccggtcgctgtttcagtcactggcgagagctttaacctgacctcggaagagattgccactcaactggccatcaaactgaaagctgaaaagatgattggtttttgctcttcccagggcgtcactaatgacgacggtgatattgtctccgaacttttccctaacgaagcgcaagcgcgggtagaagcccaggaagagaaaggcgattacaactccggtacggtgcgctttttgcgtggcgcagtgaaagcctgccgcagcggcgtgcgtcgctgtcatttaatcagttatcaggaagatggcgcgctgttgcaagagttgttctcacgcgacggtatcggtacgcagattgtgatggaaagcgccgagcagattcgtcgcgcaacaatcaacgatattggcggtattctggagttgattcgcccactggagcagcaaggtattctggtacgccgttctcgcgagcagctggagatggaaatcgacaaattcaccattattcagcgcgataacacgactattgcctgcgccgcgctctatccgttcccggaagagaagattggggaaatggcctgtgtggcagttcacccggattaccgcagttcatcaaggggtgaagttctgctggaacgcattgccgctcaggctaagcagagcggcttaagcaaattgtttgtgctgaccacgcgcagtattcactggttccaggaacgtggatttaccccagtggatattgatttactgcccgagagcaaaaagcagttgtacaactaccagcgtaaatccaaagtgttgatggcggatttagggtaa

SEQ ID NO: 103 - protein, 443 aa, Artificial Sequence
  Synthetic: Polypeptide sequence of exemplary argAfbr sequence
MVKERKTELVEGFRHSVPCINTHRGKTFVIMLGGEAIEHENFSSIVNDIGLLHSLGIRLVVVYGARPQIDANLAAHHHEPLYHKNIRVTDAKTLELVKQAAGTLQLDITARLSMSLNNTPLQGAHINVVSGNFIIAQPLGVDDGVDYCHSGRIRRIDEDAIHRQLDSGAIVLMGPVAVSVTGESFNLTSEEIATQLAIKLKAEKMIGFCSSQGVTNDDGDIVSELFPNEAQARVEAQEEKGDYNSGTVRFLRGAVKACRSGVRRCHLISYQEDGALLQELFSRDGIGTQIVMESAEQIRRATINDIGGILELIRPLEQQGILVRRSREQLEMEIDKFTIIQRDNTTIACAALYPFPEEKIGEMACVAVHPDYRSSSRGEVLLERIAAQAKQSGLSKLFVLTTRSIHWFQERGFTPVDIDLLPESKKQLYNYQRKSKVLMADLG

SEQ ID NO: 104 - protein, 26 aa, Artificial Sequence
  Synthetic: melittin
GIGAVLKVLTTGLPALISWIKRKKQQ

SEQ ID NO: 105 - protein, 37 aa, Artificial Sequence
  Synthetic: LL-37
LLGDFFRKSKEKIGKEFKRIVQRIKDFLRNLVPRTES

SEQ ID NO: 106 - protein, 35 aa, Artificial Sequence
  Synthetic: cecropin B
KWKVFKKIEKMGRNIRNGIVKAGPAIAVLGEAKAL

SEQ ID NO: 107 - protein, 24 aa, Artificial Sequence
  Synthetic: Magainin 2
GIGKFLHSAKKFGKAFVGEEIMNS

SEQ ID NO: 108 - protein, 10 aa, Artificial Sequence
  Synthetic: EZH2
FINDEIFVEL

SEQ ID NO: 109 - protein, 9 aa, Artificial Sequence
  Synthetic: EZH2
KYDCFLHPF

SEQ ID NO: 110 - protein, 9 aa, Artificial Sequence
  Synthetic: EZH2
KYVGIEREM

SEQ ID NO: 111 - protein, 9 aa, Artificial Sequence
  Synthetic: glypican-3
EYILSLEEL

SEQ ID NO: 112 - DNA, 18 bp, Artificial Sequence
  Synthetic: consensus sequence
ttgttgayryrtcaacwa

SEQ ID NO: 113 - DNA, 15 bp, Artificial Sequence
  Synthetic: consensus sequence
  misc_feature (8)..(8): n is a, c, g, or t
ttataatnattataa

SEQ ID NO: 114 - DNA, 22 bp, Artificial Sequence
  Synthetic: LacO
ggaattgtgagcgctcacaatt

SEQ ID NO: 115 - DNA, 24 bp, Artificial Sequence
  Synthetic: UP element helps recruit RNA polymerase
ggaaaatttttttaaaaaaaaaac

SEQ ID NO: 116 - DNA, 25 bp, Artificial Sequence
  Synthetic: RBS
ttatataaaagtgggaggtgcccga

SEQ ID NO: 117 - protein, 9 aa, Artificial Sequence
  Synthetic: MAGE-A1
KVLEYVIKV

SEQ ID NO: 118 - protein, 10 aa, Artificial Sequence
  Synthetic: Melan-A / MART-1
  misc_feature (1)..(1): Glu may or may not be present
EAAGIGILTV

SEQ ID NO: 119 - protein, 9 aa, Artificial Sequence
  Synthetic: Melan-A / MART-1
ILTVILGVL

SEQ ID NO: 120 - protein, 11 aa, Artificial Sequence
  Synthetic: Melan-A / MART-1
  misc_feature (11)..(11): Thr may or may not be present
AEEAAGIGILT

SEQ ID NO: 121 - protein, 11 aa, Artificial Sequence
  Synthetic: Melan-A / MART-1
RNGYRALMDKS

SEQ ID NO: 122 - protein, 12 aa, Artificial Sequence
  Synthetic: Melan-A / MART-1
EEAAGIGILTVI

SEQ ID NO: 123 - DNA, 46 bp, Artificial Sequence
  Synthetic: SR34
cgcacactggcgtcggctctggcaggatgtttcgtaattagatagc

SEQ ID NO: 124 - protein, 453 aa, Artificial Sequence
  Synthetic: Bevacizumab (Avastin) anti-VEGF, Heavy Chain
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 125 - protein, 214 aa, Artificial Sequence
  Synthetic: Bevacizumab (Avastin) anti-VEGF, Light Chain
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 126 - protein, 9 aa, Artificial Sequence
  Synthetic: D-peptide A
RLYLRIGRR

SEQ ID NO: 127 - protein, 9 aa, Artificial Sequence
  Synthetic: D-peptide B
RLRLRIGRR

SEQ ID NO: 128 - protein, 9 aa, Artificial Sequence
  Synthetic: D-peptide C
ALYLAIRRR

SEQ ID NO: 129 - protein, 9 aa, Artificial Sequence
  Synthetic: D-peptide D
RLLLRIGRR

SEQ ID NO: 130 - protein, 15 aa, Artificial Sequence
  Synthetic: D-K6L9
LKLLKKLLKKLLKLL

SEQ ID NO: 131 - protein, 26 aa, Artificial Sequence
  Synthetic: NRC-03
GRRKRKWLRRIGKGVKIIGGAALDHL

SEQ ID NO: 132 - protein, 25 aa, Artificial Sequence
  Synthetic: NRC-07
RWGKWFKKATHVGKHVGKAALTAYL

SEQ ID NO: 133 - protein, 18 aa, Artificial Sequence
  Synthetic: Gomesin
ZCRRLCYKQRCVTYCRGR

SEQ ID NO: 134 - protein, 20 aa, Artificial Sequence
  Synthetic: Hepcidin TH2-3
QSHLSLCRWCCNCCRSNKGC

SEQ ID NO: 135 - protein, 33 aa, Artificial Sequence
  Synthetic: Dermaseptin B2
GLWSKIKEVGKEAAKAAAKAAGKAALGAVSEAV

SEQ ID NO: 136 - protein, 13 aa, Artificial Sequence
  Synthetic: PTP7
FLGALFKALSKLL

SEQ ID NO: 137 - protein, 42 aa, Artificial Sequence
  Synthetic: MGA2
GIGKFLHSAKKFGKAFVGEIMNSGGKKWKMRRNQFWVKVQRG

SEQ ID NO: 138 - protein, 30 aa, Artificial Sequence
  Synthetic: HNP-1
ACYCRIPACIAGERRYGTCIYQGRLWAFCC

SEQ ID NO: 139 - protein, 17 aa, Artificial Sequence
  Synthetic: Tachyplesin
KWCFRVCYRGICYRRCR

SEQ ID NO: 140 - protein, 15 aa, Artificial Sequence
  Synthetic: Temporin-1CEa
FVDLKKIANIINSIF

SEQ ID NO: 141 - protein, 27 aa, Artificial Sequence
  Synthetic: NK-2
KILRGVCKKIMRTFLRRISKDILTGKK

SEQ ID NO: 142 - protein, 6 aa, Artificial Sequence
  Synthetic: Bovine lactoferricin B6 (Lbcin B6)
RRWQWR

SEQ ID NO: 143 - protein, 34 aa, Artificial Sequence
  Synthetic: Cecropin CB1
KWKVFKKIEKMGRNIRNGIVKAGPKWKVFKKIEK

SEQ ID NO: 144 - protein, 26 aa, Artificial Sequence
  Synthetic: Melittin
GIGAVLKVLTTGLPALISWIKRKRQQ

SEQ ID NO: 145 - protein, 17 aa, Artificial Sequence
  Synthetic: Tachyplesin
KWCFRVCYRGICYRRCR

SEQ ID NO: 146 - protein, 37 aa, Artificial Sequence; identical to SEQ ID NO: 105
  Synthetic: LL-37

SEQ ID NO: 147 - protein, 35 aa, Artificial Sequence; identical to SEQ ID NO: 106
  Synthetic: Cecropin B

SEQ ID NO: 148 - protein, 23 aa, Artificial Sequence
  Synthetic: Magainin 2
GIGKFLHSAKKFGKAFVGEIMNS

SEQ ID NO: 149 - protein, 21 aa, Artificial Sequence
  Synthetic: Buforin IIb
RAGLQFPVGRLLRRLLRRLLR

SEQ ID NO: 150 - protein, 13 aa, Artificial Sequence
  Synthetic: Alloferon-1
HGVSGHGQHGVHG

SEQ ID NO: 151 - protein, 12 aa, Artificial Sequence
  Synthetic: Alloferon-2
GVSGHGQHGVHG

SEQ ID NO: 152 - protein, 253 aa, Artificial Sequence
  Synthetic: interleukin-12 subunit alpha precursor (homo sapiens)
MWPPGSASQPPPSPAAATGLHPAARPVSLQCRLSMCPARSLLLVATLVLLDHLSLARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 153 - protein, 328 aa, Artificial Sequence
  Synthetic: interleukin-12 subunit beta precursor (homo sapiens)
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 154 - protein, 162 aa, Artificial Sequence
  Synthetic: interleukin-15 isoform1 preproprotein (homo sapiens)
MRISKPHLRSISIQCYLCLLLNSHFLTEAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 155 - protein, 135 aa, Artificial Sequence
  Synthetic: interleukin-15 isoform 2 preproprotein (homo sapiens)
MVLGTIDLCSCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 156 - protein, 153 aa, Artificial Sequence
  Synthetic: interleukin-2 precursor (homo sapiens)
MYRMQLLSCIALSLALVTNSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 157 - protein, 162 aa, Artificial Sequence
  Synthetic: interleukin-21 isoform 1 precursor (homo sapiens)
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 158 - protein, 153 aa, Artificial Sequence
  Synthetic: interleukin-21 isoform 2 precursor (homo sapiens)
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKVSTLSFI

SEQ ID NO: 159 - protein, 144 aa, Artificial Sequence
  Synthetic: granulocyte-macrophage colony-stimulating factor precursor (homo sapiens)
MWLQSLLLLGTVACSISAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 160 - protein, 10 aa, Artificial Sequence
  Synthetic: alpha-actinin-4
FIASNGVKLV

SEQ ID NO: 161 - protein, 16 aa, Artificial Sequence
  Synthetic: ARTC1
YSVYFNLPADTIYTNH

SEQ ID NO: 162 - protein, 9 aa, Artificial Sequence
  Synthetic: BCR-ABL fusion protein (b3a2)
SSKALQRPV

SEQ ID NO: 163 - protein, 9 aa, Artificial Sequence
  Synthetic: BCR-ABL fusion protein (b3a2)
GFKQSSKAL

SEQ ID NO: 164 - protein, 17 aa, Artificial Sequence
  Synthetic: BCR-ABL fusion protein (b3a2)
ATGFKQSSKALQRPVAS

SEQ ID NO: 165 - protein, 29 aa, Artificial Sequence
  Synthetic: B-RAF
EDLTVKIGDFGLATEKSRWSGSHQFEQLS

SEQ ID NO: 166 - protein, 10 aa, Artificial Sequence
  Synthetic: CASP-5
FLIIWQNTMG

SEQ ID NO: 167 - protein, 9 aa, Artificial Sequence
  Synthetic: CASP-8
FPSDSWCYF

SEQ ID NO: 168 - protein, 9 aa, Artificial Sequence
  Synthetic: beta-catenin
SYLDSGIHF

SEQ ID NO: 169 - protein, 13 aa, Artificial Sequence
  Synthetic: Cdc27
FSWAMDLDPKGAE

SEQ ID NO: 170 - protein, 10 aa, Artificial Sequence
  Synthetic: CDK4
ACDPHSGHFV

SEQ ID NO: 171 - protein, 9 aa, Artificial Sequence
  Synthetic: CDK12
CILGKLFTK

SEQ ID NO: 172 - protein, 10 aa, Artificial Sequence
  Synthetic: CDKN2A
AVCPWTWLRG

SEQ ID NO: 173 - protein, 9 aa, Artificial Sequence
  Synthetic: CLPP
ILDKVLVHL

SEQ ID NO: 174 - protein, 15 aa, Artificial Sequence
  Synthetic: COA-1
TLYQDDTLTLQAAGE

SEQ ID NO: 175 - protein, 9 aa, Artificial Sequence
  Synthetic: CSNK1A1
GLFGDIYLA

SEQ ID NO: 176 - protein, 16 aa, Artificial Sequence
  Synthetic: dek-can fusion protein
TMKQICKKEIRRLHQY

SEQ ID NO: 177 - protein, 10 aa, Artificial Sequence
  Synthetic: EFTUD2
KILDAVVAQK

SEQ ID NO: 178 - protein, 9 aa, Artificial Sequence
  Synthetic: Elongation factor 2
ETVSEQSNV

SEQ ID NO: 179 - protein, 10 aa, Artificial Sequence
  Synthetic: ETV6-AML1 fusion protein
RIAECILGMI

SEQ ID NO: 180 - protein, 15 aa, Artificial Sequence
  Synthetic: ETV6-AML1 fusion protein
IGRIAECILGMNPSR

SEQ ID NO: 181 - protein, 10 aa, Artificial Sequence
  Synthetic: FLT3-ITD
YVDFREYEYY

SEQ ID NO: 182 - protein, 9 aa, Artificial Sequence
  Synthetic: FNDC3B
VVMSWAPPV

SEQ ID NO: 183 - protein, 14 aa, Artificial Sequence
  Synthetic: FN1
MIFEKHGFRRTTPP

SEQ ID NO: 184 - protein, 10 aa, Artificial Sequence
  Synthetic: GAS7
SLADEAEVYL

SEQ ID NO: 185 - protein, 10 aa, Artificial Sequence
  Synthetic: GPNMB
TLDWLLQTPK

SEQ ID NO: 186 - protein, 9 aa, Artificial Sequence
  Synthetic: HAUS3
ILNAMIAKI

SEQ ID NO: 187 - protein, 8 aa, Artificial Sequence
  Synthetic: HSDL1
CYMEAVAL

SEQ ID NO: 188 - protein, 9 aa, Artificial Sequence
  Synthetic: LDLR-fucosyltransferaseAS
WRRAPAPGA

SEQ ID NO: 189 - protein, 9 aa, Artificial Sequence
  Synthetic: fusion protein
PVTWRRAPA

SEQ ID NO: 190-191 - skipped (2 entries)

SEQ ID NO: 192 - protein, 10 aa, Artificial Sequence
  Synthetic: hsp70-2
SLFEGIDIYT

SEQ ID NO: 193 - protein, 9 aa, Artificial Sequence
  Synthetic: hsp70-2
AEPINIQTW

SEQ ID NO: 194 - protein, 11 aa, Artificial Sequence
  Synthetic: MART2
FLEGNEVGKTY

SEQ ID NO: 195 - protein, 9 aa, Artificial Sequence
  Synthetic: MATN
KTLTSVFQK

SEQ ID NO: 196 - protein, 9 aa, Artificial Sequence
  Synthetic: ME1
FLDEFMEGV

SEQ ID NO: 197 - protein, 9 aa, Artificial Sequence
  Synthetic: MUM-1f
EEKLIVVLF

SEQ ID NO: 198 - protein, 11 aa, Artificial Sequence
  Synthetic: MUM-2
SELFRSGLDSY

SEQ ID NO: 199 - protein, 9 aa, Artificial Sequence
  Synthetic: MUM-2
FRSGLDSYV

SEQ ID NO: 200 - protein, 9 aa, Artificial Sequence
  Synthetic: MUM-3
EAFIQPITR

SEQ ID NO: 201 - protein, 12 aa, Artificial Sequence
  Synthetic: neo-PAP
RVIKNSIRLTLE

SEQ ID NO: 202 - protein, 9 aa, Artificial Sequence
  Synthetic: Myosin class I
KINKNPKYK

SEQ ID NO: 203 - protein, 8 aa, Artificial Sequence
  Synthetic: NFYC
QQITKTEV

SEQ ID NO: 204 - protein, 11 aa, Artificial Sequence
  Synthetic: OGT
SLYKFSPFPLG

SEQ ID NO: 205 - protein, 9 aa, Artificial Sequence
  Synthetic: OS-9
KELEGILLL

SEQ ID NO: 206 - protein, 9 aa, Artificial Sequence
  Synthetic: p53
VVPCEPPEV

SEQ ID NO: 207 - protein, 25 aa, Artificial Sequence
  Synthetic: pml-RARalpha fusion protein
NSNHVASGAGEAAIETQSSSSEEIV

SEQ ID NO: 208 - protein, 9 aa, Artificial Sequence
  Synthetic: PPP1R3B
YTDFHCQYV

SEQ ID NO: 209 - protein, 10 aa, Artificial Sequence
  Synthetic: PRDX5
LLLDDLLVSI

SEQ ID NO: 210 - protein, 16 aa, Artificial Sequence
  Synthetic: PTPRK
PYYFAAELPPRNLPEP

SEQ ID NO: 211 - protein, 9 aa, Artificial Sequence
  Synthetic: K-ras
VVVGAVGVG

SEQ ID NO: 212 - protein, 10 aa, Artificial Sequence
  Synthetic: N-ras
ILDTAGREEY

SEQ ID NO: 213 - protein, 9 aa, Artificial Sequence
  Synthetic: RBAF600
RPHVPESAF

SEQ ID NO: 214 - protein, 9 aa, Artificial Sequence
  Synthetic: SIRT2
KIFSEVTLK

SEQ ID NO: 215 - protein, 9 aa, Artificial Sequence
  Synthetic: SNRPD1
SHETVIIEL

SEQ ID NO: 216 - protein, 10 aa, Artificial Sequence
  Synthetic: SYT-SSX1 or -SSX2 fusion protein
QRPYGYDQIM

SEQ ID NO: 217 - protein, 10 aa, Artificial Sequence
  Synthetic: TGF-betaRII
RLSSCVPVAG

SEQ ID NO: 218 - protein, 15 aa, Artificial Sequence
  Synthetic: Triosephosphate isomerase
GELIGILNAAKVPAD

SEQ ID NO: 219 - protein, 9 aa, Artificial Sequence
  Synthetic: Cyclin-A1
FLDRFLSCM

SEQ ID NO: 220 - protein, 11 aa, Artificial Sequence
  Synthetic: Cyclin-A1
SLIAAAAFCLA

SEQ ID NO: 221 - protein, 8 aa, Artificial Sequence
  Synthetic: GAGE-1,2,8
YRPRPRRY

SEQ ID NO: 222 - protein, 9 aa, Artificial Sequence
  Synthetic: GAGE-3,4,5,6,7
YYWPRPRRY

SEQ ID NO: 223 - protein, 10 aa, Artificial Sequence
  Synthetic: GnTVf
  misc_feature (10)..(10): Val may or may not be present
VLPDVFIRCV

SEQ ID NO: 224 - protein, 9 aa, Artificial Sequence
  Synthetic: HERV-K-MEL
MLAVISCAV

SEQ ID NO: 225 - protein, 9 aa, Artificial Sequence
  Synthetic: KK-LC-1
RQKRILVNL

SEQ ID NO: 226 - protein, 9 aa, Artificial Sequence
  Synthetic: KM-HN-1
NYNNFYRFL

SEQ ID NO: 227 - protein, 10 aa, Artificial Sequence
  Synthetic: KM-HN-1
EYSKECLKEF

SEQ ID NO: 228 - protein, 9 aa, Artificial Sequence
  Synthetic: KM-HN-1
EYLSLSDKI

SEQ ID NO: 229 - protein, 11 aa, Artificial Sequence
  Synthetic: LAGE-1
MLMAQEALAFL

SEQ ID NO: 230 - protein, 9 aa, Artificial Sequence
  Synthetic: LAGE-1
SLLMWITQC

SEQ ID NO: 231 - protein, 10 aa, Artificial Sequence
  Synthetic: LAGE-1
LAAQERRVPR

SEQ ID NO: 232 - protein, 9 aa, Artificial Sequence
  Synthetic: LAGE-1
ELVRRILSR

SEQ ID NO: 233 - protein, 9 aa, Artificial Sequence
  Synthetic: LAGE-1
APRGVRMAV

SEQ ID NO: 234 - protein, 14 aa, Artificial Sequence
  Synthetic: LAGE-1
SLLMWITQCFLPVF

SEQ ID NO: 235 - protein, 20 aa, Artificial Sequence
  Synthetic: LAGE-1
QGAMLAAQERRVPRAAEVPR

SEQ ID NO: 236 - protein, 18 aa, Artificial Sequence
  Synthetic: LAGE-1
AADHRQLQLSISSCLQQL

SEQ ID NO: 237 - protein, 22 aa, Artificial Sequence
  Synthetic: LAGE-1
CLSRRPWKRSWSAGSCPGMPHL

SEQ ID NO: 238 - protein, 13 aa, Artificial Sequence
  Synthetic: LAGE-1
ILSRDAAPLPRPG

SEQ ID NO: 239 - protein, 14 aa, Artificial Sequence
  Synthetic: LAGE-1
AGATGGRGPRGAGA

SEQ ID NO: 240 - protein, 10 aa, Artificial Sequence
  Synthetic: LY6K
RYCNLEGPPI

SEQ ID NO: 241 - protein, 24 aa, Artificial Sequence
  Synthetic: LY6K
KWTEPYCVIAAVKIFPRFFMVAKQ

SEQ ID NO: 242 - protein, 20 aa, Artificial Sequence
  Synthetic: LY6K
KCCKIRYCNLEGPPINSSVF

SEQ ID NO: 243 - protein, 9 aa, Artificial Sequence
  Synthetic: MAGE-A1
EADPTGHSY

SEQ ID NO: 244 - protein, 9 aa, Artificial Sequence
  Synthetic: MAGE-A1
SLFRAVITK

SEQ ID NO: 245 - protein, 10 aa, Artificial Sequence
  Synthetic: MAGE-A1
EVYDGREHSA

SEQ ID NO: 246 - protein, 9 aa, Artificial Sequence
  Synthetic: MAGE-A1
RVRFFFPSL

SEQ ID NO: 247 - protein, 9 aa, Artificial Sequence
  Synthetic: MAGE-A1
EADPTGHSY

SEQ ID NO: 248 - protein, 10 aa, Artificial Sequence
  Synthetic: MAGE-A1
REPVTKAEML

SEQ ID NO: 249 - protein, 10 aa, Artificial Sequence
  Synthetic: MAGE-A1
KEADPTGHSY

SEQ ID NO: 250 - protein, 9 aa, Artificial Sequence
  Synthetic: MAGE-A1
DPARYEFLW

SEQ ID NO: 251 - protein, 11 aa, Artificial Sequence
  Synthetic: MAGE-A1
ITKKVADLVGF

SEQ ID NO: 252 - protein, 9 aa, Artificial Sequence
  Synthetic: MAGE-A1
SAFPTTINF

SEQ ID NO: 253 - protein, 9 aa, Artificial Sequence
  Synthetic: MAGE-A1
SAYGEPRKL

SEQ ID NO: 254 - protein, 9 aa, Artificial Sequence
  Synthetic: MAGE-A1
RVRFFFPSL

SEQ ID NO: 255 - protein, 9 aa, Artificial Sequence
  Synthetic: MAGE-A1
SAYGEPRKL

SEQ ID NO: 256 - protein, 15 aa, Artificial Sequence
  Synthetic: MAGE-A1
TSCILESLFRAVITK

SEQ ID NO: 257 - protein, 15 aa, Artificial Sequence
  Synthetic: MAGE-A1
PRALAETSYVKVLEY

SEQ ID NO: 258 - protein, 16 aa, Artificial Sequence
  Synthetic: MAGE-A1
FLLLKYRAREPVTKAE

SEQ ID NO: 259 - protein, 12 aa, Artificial Sequence
  Synthetic: MAGE-A1
EYVIKVSARVRF

SEQ ID NO: 260 - protein, 10 aa, Artificial Sequence
  Synthetic: MAGE-A2
YLQLVFGIEV

SEQ ID NO: 261 - protein, 9 aa, Artificial Sequence
  Synthetic: MAGE-A2
EYLQLVFGI

SEQ ID NO: 262 - protein, 10 aa, Artificial Sequence
  Synthetic: MAGE-A2
REPVTKAEML

SEQ ID NO: 263 - protein, 9 aa, Artificial Sequence
  Synthetic: MAGE-A2
EGDCAPEEK

SEQ ID NO: 264 - protein, 14 aa, Artificial Sequence
  Synthetic: MAGE-A2
LLKYRAREPVTKAE

SEQ ID NO: 265 - protein, 9 aa, Artificial Sequence
  Synthetic: MAGE-A3
EVDPIGHLY

SEQ ID NO: 266 - protein, 10 aa, Artificial Sequence
  Synthetic: MAGE-A3
FLWGPRALVD

SEQ ID NO: 267 - protein, 9 aa, Artificial Sequence
  Synthetic: MAGE-A3
KVAELVHFL

SEQ ID NO: 268 - protein, 9 aa, Artificial Sequence
  Synthetic: MAGE-A3
TFPDLESEF

SEQ ID NO: 269 - protein, 9 aa, Artificial Sequence
  Synthetic: MAGE-A3
VAELVHFLL

SEQ ID NO: 270 - protein, 10 aa, Artificial Sequence
  Synthetic: MAGE-A3
MEVDPIGHLY

SEQ ID NO: 271 - protein, 9 aa, Artificial Sequence
  Synthetic: MAGE-A3
EVDPIGHLY

SEQ ID NO: 272 - protein, 10 aa, Artificial Sequence
  Synthetic: MAGE-A3
REPVTKAEML

SEQ ID NO: 273 - protein, 10 aa, Artificial Sequence
  Synthetic: MAGE-A3
AELVHFLLLI

SEQ ID NO: 274 - protein, 10 aa, Artificial Sequence
  Synthetic: MAGE-A3
MEVDPIGHLY

SEQ ID NO: 275 - protein, 9 aa, Artificial Sequence
  Synthetic: MAGE-A3
WQYFFPVIF

SEQ ID NO: 276 - protein, 9 aa, Artificial Sequence
  Synthetic: MAGE-A3
EGDCAPEEK

SEQ ID NO: 277 - protein, 16 aa, Artificial Sequence
  Synthetic: MAGE-A3
KKLLTQHFVQENYLEY

SEQ ID NO: 278 - protein, 15 aa, Artificial Sequence
  Synthetic: MAGE-A3
RKVAELVHFLLLKYR

SEQ ID NO: 279 - protein, 16 aa, Artificial Sequence
  Synthetic: MAGE-A3
KKLLTQHFVQENYLEY

SEQ ID NO: 280 - protein, 16 aa, Artificial Sequence
  Synthetic: MAGE-A3
ACYEFLWGPRALVETS

SEQ ID NO: 281 - protein, 15 aa, Artificial Sequence
  Synthetic: MAGE-A3
RKVAELVHFLLLKYR

SEQ ID NO: 282 - protein, 12 aa, Artificial Sequence
  Synthetic: MAGE-A3
VIFSKASSSLQL

SEQ ID NO: 283 - protein, 15 aa, Artificial Sequence
  Synthetic: MAGE-A3
VFGIELMEVDPIGHL

SEQ ID NO: 284 - protein, 15 aa, Artificial Sequence
  Synthetic: MAGE-A3
GDNQIMPKAGLLIIV

SEQ ID NO: 285 - protein, 15 aa, Artificial Sequence
  Synthetic: MAGE-A3
TSYVKVLHHMVKISG

SEQ ID NO: 286 - protein, 16 aa, Artificial Sequence
  Synthetic: MAGE-A3
RKVAELVHFLLLKYRA

SEQ ID NO: 287 - protein, 16 aa, Artificial Sequence
  Synthetic: MAGE-A3
FLLLKYRAREPVTKAE

SEQ ID NO: 288 - protein, 9 aa, Artificial Sequence
  Synthetic: MAGE-A4
EVDPASNTY

SEQ ID NO: 289 - protein, 10 aa, Artificial Sequence
  Synthetic: MAGE-A4
GVYDGREHTV

SEQ ID NO: 290 - protein, 9 aa, Artificial Sequence
  Synthetic: MAGE-A4
NYKRCFPVI

SEQ ID NO: 291 - protein, 8 aa, Artificial Sequence
  Synthetic: MAGE-A4
SESLKMIF

SEQ ID NO: 292 - protein, 9 aa, Artificial Sequence
  Synthetic: MAGE-A6
MVKISGGPR

SEQ ID NO: 293 - protein, 9 aa, Artificial Sequence
  Synthetic: MAGE-A6
EVDPIGHVY

SEQ ID NO: 294 - protein, 10 aa, Artificial Sequence
  Synthetic: MAGE-A6
REPVTKAEML

SEQ ID NO: 295 - protein, 9 aa, Artificial Sequence
  Synthetic: MAGE-A6
EGDCAPEEK

SEQ ID NO: 296 - protein, 9 aa, Artificial Sequence
  Synthetic: MAGE-A6
ISGGPRISY

SEQ ID NO: 297 - protein, 14 aa, Artificial Sequence
  Synthetic: MAGE-A6
LLKYRAREPVTKAE

SEQ ID NO: 298 - protein, 9 aa, Artificial Sequence
  Synthetic: MAGE-A9
ALSVMGVYV

SEQ ID NO: 299 - protein, 10 aa, Artificial Sequence
  Synthetic: MAGE-A10
GLYDGMEHLL

SEQ ID NO: 300 - protein, 9 aa, Artificial Sequence
  Synthetic: MAGE-A10
DPARYEFLW

SEQ ID NO: 301 - protein, 10 aa, Artificial Sequence
  Synthetic: MAGE-A12 m
FLWGPRALVE

SEQ ID NO: 302 - protein, 9 aa, Artificial Sequence
  Synthetic: MAGE-A12 m
VRIGHLYIL

SEQ ID NO: 303 - protein, 9 aa, Artificial Sequence
  Synthetic: MAGE-A12 m
EGDCAPEEK

SEQ ID NO: 304 - protein, 15 aa, Artificial Sequence
  Synthetic: MAGE-A12 m
REPFTKAEMLGSVIR

SEQ ID NO: 305 - protein, 14 aa, Artificial Sequence
  Synthetic: MAGE-A12 m
AELVHFLLLKYRAR

SEQ ID NO: 306 - protein, 10 aa, Artificial Sequence
  Synthetic: MAGE-C1
ILFGISLREV

SEQ ID NO: 307 - protein, 9 aa, Artificial Sequence
  Synthetic: MAGE-C1
KVVEFLAML

SEQ ID NO: 308 - protein, 13 aa, Artificial Sequence
  Synthetic: MAGE-C1
SSALLSIFQSSPE

SEQ ID NO: 309 - protein, 9 aa, Artificial Sequence
  Synthetic: MAGE-C1
SFSYTLLSL

SEQ ID NO: 310 - protein, 9 aa, Artificial Sequence
  Synthetic: MAGE-C1
VSSFFSYTL

SEQ ID NO: 311 - protein, 10 aa, Artificial Sequence
  Synthetic: MAGE-C2
LLFGLALIEV

SEQ ID NO: 312 - protein, 9 aa, Artificial Sequence
  Synthetic: MAGE-C2
ALKDVEERV

SEQ ID NO: 313 - protein, 9 aa, Artificial Sequence
  Synthetic: MAGE-C2
SESIKKKVL

SEQ ID NO: 314 - protein, 9 aa, Artificial Sequence
  Synthetic: MAGE-C2
ASSTLYLVF

SEQ ID NO: 315 - protein, 15 aa, Artificial Sequence
  Synthetic: MAGE-C2
SSTLYLVFSPSSFST

SEQ ID NO: 316 - protein, 20 aa, Artificial Sequence
  Synthetic: mucink
PDTRPAPGSTAPPAHGVTSA

SEQ ID NO: 317 - protein, 9 aa, Artificial Sequence
  Synthetic: NA88-A
QGQHFLQKV

SEQ ID NO: 318 - protein, 9 aa, Artificial Sequence
  Synthetic: NY-ESO-1 / LAGE-2
SLLMWITQC

SEQ ID NO: 319 - protein, 11 aa, Artificial Sequence
  Synthetic: NY-ESO-1 / LAGE-2
MLMAQEALAFL

SEQ ID NO: 320 - protein, 11 aa, Artificial Sequence
  Synthetic: NY-ESO-1 / LAGE-2
YLAMPFATPME

SEQ ID NO: 321 - protein, 10 aa, Artificial Sequence
  Synthetic: NY-ESO-1 / LAGE-2
ASGPGGGAPR

SEQ ID NO: 322 - protein, 10 aa, Artificial Sequence
  Synthetic: NY-ESO-1 / LAGE-2
LAAQERRVPR

SEQ ID NO: 323 - protein, 10 aa, Artificial Sequence
  Synthetic: NY-ESO-1 / LAGE-2
TVSGNILTIR

SEQ ID NO: 324 - protein, 13 aa, Artificial Sequence
  Synthetic: NY-ESO-1 / LAGE-2
APRGPHGGAASGL

SEQ ID NO: 325 - protein, 11 aa, Artificial Sequence
  Synthetic: NY-ESO-1 / LAGE-2
MPFATPMEAEL

SEQ ID NO: 326 - protein, 12 aa, Artificial Sequence
  Synthetic: NY-ESO-1 / LAGE-2
KEFTVSGNILTI

SEQ ID NO: 327 - protein, 9 aa, Artificial Sequence
  Synthetic: NY-ESO-1 / LAGE-2
MPFATPMEA

SEQ ID NO: 328 - protein, 9 aa, Artificial Sequence
  Synthetic: NY-ESO-1 / LAGE-2
FATPMEAEL

SEQ ID NO: 329 - protein, 11 aa, Artificial Sequence
  Synthetic: NY-ESO-1 / LAGE-2
FATPMEAELAR

SEQ ID NO: 330 - protein, 9 aa, Artificial Sequence
  Synthetic: NY-ESO-1 / LAGE-2
LAMPFATPM

SEQ ID NO: 331 - protein, 9 aa, Artificial Sequence
  Synthetic: NY-ESO-1 / LAGE-2
ARGPESRLL

SEQ ID NO: 332 - protein, 14 aa, Artificial Sequence
  Synthetic: NY-ESO-1 / LAGE-2
SLLMWITQCFLPVF

SEQ ID NO: 333 - protein, 25 aa, Artificial Sequence
  Synthetic: NY-ESO-1 / LAGE-2
LLEFYLAMPFATPMEAELARRSLAQ

SEQ ID NO: 334 - protein, 12 aa, Artificial Sequence
  Synthetic: NY-ESO-1 / LAGE-2
EFYLAMPFATPM

SEQ ID NO: 335 - protein, 25 aa, Artificial Sequence
  Synthetic: NY-ESO-1 / LAGE-2
PGVLLKEFTVSGNILTIRLTAADHR

SEQ ID NO: 336 - protein, 12 aa, Artificial Sequence
  Synthetic: NY-ESO-1 / LAGE-2
RLLEFYLAMPFA

SEQ ID NO: 337 - protein, 20 aa, Artificial Sequence
  Synthetic: NY-ESO-1 / LAGE-2
QGAMLAAQERRVPRAAEVPR

SEQ ID NO: 338 - protein, 13 aa, Artificial Sequence
  Synthetic: NY-ESO-1 / LAGE-2
PFATPMEAELARR

SEQ ID NO: 339 - protein, 20 aa, Artificial Sequence
  Synthetic: NY-ESO-1 / LAGE-2
PGVLLKEFTVSGNILTIRLT

SEQ ID NO: 340 - protein, 10 aa, Artificial Sequence
  Synthetic: NY-ESO-1 / LAGE-2
VLLKEFTVSG

SEQ ID NO: 341 - protein, 18 aa, Artificial Sequence
  Synthetic: NY-ESO-1 / LAGE-2
AADHRQLQLSISSCLQQL

SEQ ID NO: 342 - protein, 25 aa, Artificial Sequence
  Synthetic: NY-ESO-1 / LAGE-2
LLEFYLAMPFATPMEAELARRSLAQ

SEQ ID NO: 343 - protein, 15 aa, Artificial Sequence
  Synthetic: NY-ESO-1 / LAGE-2
LKEFTVSGNILTIRL

SEQ ID NO: 344 - protein, 25 aa, Artificial Sequence
  Synthetic: NY-ESO-1 / LAGE-2
PGVLLKEFTVSGNILTIRLTAADHR

SEQ ID NO: 345 - protein, 11 aa, Artificial Sequence
  Synthetic: NY-ESO-1 / LAGE-2
KEFTVSGNILT

SEQ ID NO: 346 - protein, 14 aa, Artificial Sequence
  Synthetic: NY-ESO-1 / LAGE-2
LLEFYLAMPFATPM

SEQ ID NO: 347 - protein, 14 aa, Artificial Sequence
  Synthetic: NY-ESO-1 / LAGE-2
AGATGGRGPRGAGA

SEQ ID NO: 348 - protein, 9 aa, Artificial Sequence
  Synthetic: SAGE
LYATVIHDI

SEQ ID NO: 349 - protein, 9 aa, Artificial Sequence
  Synthetic: Sp17
ILDSSEEDK

SEQ ID NO: 350 - protein, 9 aa, Artificial Sequence
  Synthetic: SSX-2
KASEKIFYV

SEQ ID NO: 351 - protein, 16 aa, Artificial Sequence
  Synthetic: SSX-2
EKIQKAFDDIAKYFSK

SEQ ID NO: 352 - protein, 11 aa, Artificial Sequence
  Synthetic: SSX-2
FGRLQGISPKI

SEQ ID NO: 353 - protein, 18 aa, Artificial Sequence
  Synthetic: SSX-2
WEKMKASEKIFYVYMKRK

SEQ ID NO: 354 - protein, 15 aa, Artificial Sequence
  Synthetic: SSX-2
KIFYVYMKRKYEAMT

SEQ ID NO: 355 - protein, 14 aa, Artificial Sequence
  Synthetic: SSX-2
KIFYVYMKRKYEAM

SEQ ID NO: 356 - protein, 20 aa, Artificial Sequence
  Synthetic: SSX-4
INKTSGPKRGKHAWTHRLRE

SEQ ID NO: 357 - protein, 20 aa, Artificial Sequence
  Synthetic: SSX-4
YFSKKEWEKMKSSEKIVYVY

SEQ ID NO: 358 - protein, 20 aa, Artificial Sequence
  Synthetic: SSX-4
MKLNYEVMTKLGFKVTLPPF

SEQ ID NO: 359 - protein, 20 aa, Artificial Sequence
  Synthetic: SSX-4
KHAWTHRLRERKQLVVYEEI

SEQ ID NO: 360 - protein, 20 aa, Artificial Sequence
  Synthetic: SSX-4
LGFKVTLPPFMRSKRAADFH

SEQ ID NO: 361 - protein, 20 aa, Artificial Sequence
  Synthetic: SSX-4
KSSEKIVYVYMKLNYEVMTK

SEQ ID NO: 362 - protein, 20 aa, Artificial Sequence
  Synthetic: SSX-4
KHAWTHRLRERKQLVVYEEI

SEQ ID NO: 363 - protein, 9 aa, Artificial Sequence
  Synthetic: TAG-1
SLGWLFLLL

SEQ ID NO: 364 - protein, 9 aa, Artificial Sequence
  Synthetic: TAG-1
LSRLSNRLL

SEQ ID NO: 365 - protein, 15 aa, Artificial Sequence
  Synthetic: TRAG-3
CEFHACWPAFTVLGE

SEQ ID NO: 366 - protein, 15 aa, Artificial Sequence
  Synthetic: TRAG-3
CEFHACWPAFTVLGE

SEQ ID NO: 367 - protein, 10 aa, Artificial Sequence
  Synthetic: TRP2-INT2g
EVISCKLIKR

SEQ ID NO: 368 - protein, 9 aa, Artificial Sequence
  Synthetic: XAGE-1b/GAGED2a
RQKKIRIQL

SEQ ID NO: 369 - protein, 16 aa, Artificial Sequence
  Synthetic: XAGE-1b/GAGED2a
HLGSRQKKIRIQLRSQ

SEQ ID NO: 370 - protein, 17 aa, Artificial Sequence
  Synthetic: XAGE-1b/GAGED2a
CATWKVICKSCISQTPG

SEQ ID NO: 371 - protein, 10 aa, Artificial Sequence
  Synthetic: CEA
YLSGANLNLG

SEQ ID NO: 372 - protein, 9 aa, Artificial Sequence
  Synthetic: CEA
IMIGVLVGV

SEQ ID NO: 373 - protein, 9 aa, Artificial Sequence
  Synthetic: CEA
GVLVGVALI

SEQ ID NO: 374 - protein, 9 aa, Artificial Sequence
  Synthetic: CEA
HLFGYSWYK

SEQ ID NO: 375 - protein, 10 aa, Artificial Sequence
  Synthetic: CEA
QYSWFVNGTF

SEQ ID NO: 376 - protein, 9 aa, Artificial Sequence
  Synthetic: CEA
TYACFVSNL

SEQ ID NO: 377 - protein, 15 aa, Artificial Sequence
  Synthetic: CEA
AYVCGIQNSVSANRS

SEQ ID NO: 378 - protein, 25 aa, Artificial Sequence
  Synthetic: CEA
DTGFYTLHVIKSDLVNEEATGQFRV

SEQ ID NO: 379 - protein, 15 aa, Artificial Sequence
  Synthetic: CEA
YSWRINGIPQQHTQV

SEQ ID NO: 380 - protein, 13 aa, Artificial Sequence
  Synthetic: CEA
TYYRPGVNLSLSC

SEQ ID NO: 381 - protein, 13 aa, Artificial Sequence
  Synthetic: CEA
EIIYPNASLLIQN

SEQ ID NO: 382 - protein, 15 aa, Artificial Sequence
  Synthetic: CEA
YACFVSNLATGRNNS

SEQ ID NO: 383 - protein, 13 aa, Artificial Sequence
  Synthetic: CEA
LWWVNNQSLPVSP

SEQ ID NO: 384 - protein, 13 aa, Artificial Sequence
  Synthetic: CEA
EIIYPNASLLIQN

SEQ ID NO: 385 - protein, 13 aa, Artificial Sequence
  Synthetic: CEA
NSIVKSITVSASG

SEQ ID NO: 386 - protein, 9 aa, Artificial Sequence
  Synthetic: gp100 / Pmel17
KTWGQYWQV

SEQ ID NO: 387 - protein, 10 aa, Artificial Sequence
  Synthetic: gp100 / Pmel17
  misc_feature (1)..(1): Ala may or may not be present
AMLGTHTMEV

SEQ ID NO: 388 - protein, 9 aa, Artificial Sequence
  Synthetic: gp100 / Pmel17
ITDQVPFSV

SEQ ID NO: 389 - protein, 9 aa, Artificial Sequence
  Synthetic: gp100 / Pmel17
YLEPGPVTA

SEQ ID NO: 390 - protein, 10 aa, Artificial Sequence
  Synthetic: gp100 / Pmel17
LLDGTATLRL

SEQ ID NO: 391 - protein, 10 aa, Artificial Sequence
  Synthetic: gp100 / Pmel17
VLYRYGSFSV

SEQ ID NO: 392 - protein, 10 aa, Artificial Sequence
  Synthetic: gp100 / Pmel17
SLADTNSLAV

SEQ ID NO: 393 - protein, 9 aa, Artificial Sequence
  Synthetic: gp100 / Pmel17
RLMKQDFSV

SEQ ID NO: 394 - protein, 9 aa, Artificial Sequence
  Synthetic: gp100 / Pmel17
RLPRIFCSC

SEQ ID NO: 395 - protein, 9 aa, Artificial Sequence
  Synthetic: gp100 / Pmel17
LIYRRRLMK

SEQ ID NO: 396 - protein, 9 aa, Artificial Sequence
  Synthetic: gp100 / Pmel17
ALLAVGATK

SEQ ID NO: 397 - protein, 10 aa, Artificial Sequence
  Synthetic: gp100 / Pmel17
IALNFPGSQK

SEQ ID NO: 398 - protein, 9 aa, Artificial Sequence
  Synthetic: gp100 / Pmel17
RSYVPLAHR

SEQ ID NO: 399 - protein, 9 aa, Artificial Sequence
  Synthetic: gp100 / Pmel17
ALNFPGSQK

SEQ ID NO: 400 - protein, 9 aa, Artificial Sequence
  Synthetic: gp100 / Pmel17
VYFFLPDHL

SEQ ID NO: 401 - protein, 9 aa, Artificial Sequence
  Synthetic: gp100 / Pmel17
RTKQLYPEW

SEQ ID NO: 402 - protein, 10 aa, Artificial Sequence
  Synthetic: gp100 / Pmel17
HTMEVTVYHR

SEQ ID NO: 403 - protein, 9 aa, Artificial Sequence
  Synthetic: gp100 / Pmel17
SSPGCQPPA

SEQ ID NO: 404 - protein, 10 aa, Artificial Sequence
  Synthetic: gp100 / Pmel17
VPLDCVLYRY

SEQ ID NO: 405 - protein, 9 aa, Artificial Sequence
  Synthetic: gp100 / Pmel17
LPHSSSHWL

SEQ ID NO: 406 - protein, 8 aa, Artificial Sequence
  Synthetic: gp100 / Pmel17
SNDGPTLI

SEQ ID NO: 407 - protein, 15 aa, Artificial Sequence
  Synthetic: gp100 / Pmel17
GRAMLGTHTMEVTVY

SEQ ID NO: 408 - protein, 16 aa, Artificial Sequence
  Synthetic: gp100 / Pmel17
WNRQLYPEWTEAQRLD

SEQ ID NO: 409 - protein, 18 aa, Artificial Sequence
  Synthetic: gp100 / Pmel17
TTEWVETTARELPIPEPE

SEQ ID NO: 410 - protein, 17 aa, Artificial Sequence
  Synthetic: gp100 / Pmel17
TGRAMLGTHTMEVTVYH

SEQ ID NO: 411 - protein, 9 aa, Artificial Sequence
  Synthetic: mammaglobin-A
PLLENVISK

SEQ ID NO: 412 - protein, 30 aa, Artificial Sequence
  Synthetic: Melan-A / MART-1
YTTAEEAAGIGILTVILGVLLLIGCWYCRR

SEQ ID NO: 413 - protein, 14 aa, Artificial Sequence
  Synthetic: Melan-A / MART-1
AAGIGILTVILGVL

SEQ ID NO: 414 - protein, 14 aa, Artificial Sequence
  Synthetic: Melan-A / MART-1
APPAYEKLPSAEQF

SEQ ID NO: 415 - protein, 23 aa, Artificial Sequence
  Synthetic: Melan-A / MART-1
RNGYRALMDKSLHVGTQCALTRR

SEQ ID NO: 416 - protein, 20 aa, Artificial Sequence
  Synthetic: Melan-A / MART-1
MPREDAHFIYGYPKKGHGHS

SEQ ID NO: 417 - protein, 20 aa, Artificial Sequence
  Synthetic: Melan-A / MART-1
KNCEPVVPNAPPAYEKLSAE

SEQ ID NO: 418 - protein, 9 aa, Artificial Sequence
  Synthetic: NY-BR-1
SLSKILDTV

SEQ ID NO: 419 - protein, 9 aa, Artificial Sequence
  Synthetic: OA1
LYSACFWWL

SEQ ID NO: 420 - protein, 9 aa, Artificial Sequence
  Synthetic: PAP
FLFLLFFWL

SEQ ID NO: 421 - protein, 9 aa, Artificial Sequence
  Synthetic: PAP
TLMSAMTNL

SEQ ID NO: 422 - protein, 9 aa, Artificial Sequence
  Synthetic: PAP
ALDVYNGLL

SEQ ID NO: 423 - protein, 10 aa, Artificial Sequence
  Synthetic: PSA
FLTPKKLQCV

SEQ ID NO: 424 - protein, 10 aa, Artificial Sequence
  Synthetic: PSA
VISNDVCAQV

SEQ ID NO: 425 - protein, 9 aa, Artificial Sequence
  Synthetic: RAB38 / NY-MEL-1
VLHWDPETV

SEQ ID NO: 426 - protein, 9 aa, Artificial Sequence
  Synthetic: TRP-1 / gp75
MSLQRQFLR

SEQ ID NO: 427 - protein, 21 aa, Artificial Sequence
  Synthetic: TRP-1 / gp75
ISPNSVFSQWRVVCDSLEDYD

SEQ ID NO: 428 - protein, 10 aa, Artificial Sequence
  Synthetic: TRP-1 / gp75
SLPYWNFATG

SEQ ID NO: 429 - protein, 15 aa, Artificial Sequence
  Synthetic: TRP-1 / gp75
SQWRVVCDSLEDYDT

SEQ ID NO: 430 - protein, 9 aa, Artificial Sequence
  Synthetic: TRP-2
SVYDFFVWL

SEQ ID NO: 431 - protein, 9 aa, Artificial Sequence
  Synthetic: TRP-2
TLDSQVMSL

SEQ ID NO: 432 - protein, 9 aa, Artificial Sequence
  Synthetic: TRP-2
LLGPGRPYR

SEQ ID NO: 433 - protein, 9 aa, Artificial Sequence
  Synthetic: TRP-2
ANDPIFVVL

SEQ ID NO: 434 - protein, 15 aa, Artificial Sequence
  Synthetic: TRP-2
QCTEVRADTRPWSGP

SEQ ID NO: 435 - protein, 10 aa, Artificial Sequence
  Synthetic: TRP-2
ALPYWNFATG

SEQ ID NO: 436 - protein, 9 aa, Artificial Sequence
  Synthetic: tyrosinase
KCDICTDEY

SEQ ID NO: 437 - protein, 11 aa, Artificial Sequence
  Synthetic: tyrosinase
SSDYVIPIGTY

SEQ ID NO: 438 - protein, 9 aa, Artificial Sequence
  Synthetic: tyrosinase
MLLAVLYCL

SEQ ID NO: 439 - protein, 10 aa, Artificial Sequence
  Synthetic: tyrosinase
CLLWSFQTSA

SEQ ID NO: 440 - protein, 9 aa, Artificial Sequence
  Synthetic: tyrosinase
YMDGTMSQV

SEQ ID NO: 441 - protein, 9 aa, Artificial Sequence
  Synthetic: tyrosinase
AFLPWHRLF

SEQ ID NO: 442 - protein, 11 aa, Artificial Sequence
  Synthetic: tyrosinase
IYMDGTADFSF

SEQ ID NO: 443 - protein, 9 aa, Artificial Sequence
  Synthetic: tyrosinase
QCSGNFMGF

SEQ ID NO: 444 - protein, 12 aa, Artificial Sequence
  Synthetic: tyrosinase
TPRLPSSADVEF

SEQ ID NO: 445 - protein, 9 aa, Artificial Sequence
  Synthetic: tyrosinase
LPSSADVEF

SEQ ID NO: 446 - protein, 10 aa, Artificial Sequence
  Synthetic: tyrosinase
LHHAFVDSIF

SEQ ID NO: 447 - protein, 10 aa, Artificial Sequence
  Synthetic: tyrosinase
SEIWRDIDFD

SEQ ID NO: 448 - protein, 15 aa, Artificial Sequence
  Synthetic: tyrosinase
QNILLSNAPLGPQFP

SEQ ID NO: 449 - protein, 13 aa, Artificial Sequence
  Synthetic: tyrosinase
SYLQDSDPDSFQD

SEQ ID NO: 450 - protein, 21 aa, Artificial Sequence [sequence omitted]

SEQ ID NO: 451 - protein, 9 aa, Artificial Sequence
  Synthetic: adipophilin
SVASTITGV

SEQ ID NO: 452 - protein, 10 aa, Artificial Sequence
  Synthetic: AIM-2
RSDSGQQARY

SEQ ID NO: 453 - protein, 9 aa, Artificial Sequence
  Synthetic: ALDH1A1
LLYKLADLI

SEQ ID NO: 454 - protein, 10 aa, Artificial Sequence
  Synthetic: BCLX(L)
YLNDHLEPWI

SEQ ID NO: 455 - protein, 9 aa, Artificial Sequence
  Synthetic: BING-4
CQWGRLWQL

SEQ ID NO: 456 - protein, 10 aa, Artificial Sequence
  Synthetic: CALCA
VLLQAGSLHA

SEQ ID NO: 457 - protein, 9 aa, Artificial Sequence
  Synthetic: CD45
KFLDALISL

SEQ ID NO: 458 - protein, 9 aa, Artificial Sequence
  Synthetic: CD274
LLNAFTVTV

SEQ ID NO: 459 - protein, 9 aa, Artificial Sequence
  Synthetic: CPSF
KVHPVIWSL

SEQ ID NO: 460 - protein, 10 aa, Artificial Sequence
  Synthetic: peptide
LMLQNALTTM

SEQ ID NO: 461 - protein, 9 aa, Artificial Sequence
  Synthetic: cyclinD1
LLGATCMFV

SEQ ID NO: 462 - protein, 15 aa, Artificial Sequence
  Synthetic: peptide
NPPSMVAAGSVVAAV

SEQ ID NO: 463 - protein, 10 aa, Artificial Sequence
  Synthetic: DKK1
ALGGHPLLGV

SEQ ID NO: 464 - protein, 9 aa, Artificial Sequence
  Synthetic: ENAH(hMena)
TMNGSKSPV

SEQ ID NO: 465 - protein, 9 aa, Artificial Sequence
  Synthetic: EpCAM
RYQLDPKFI

SEQ ID NO: 466 - protein, 12 aa, Artificial Sequence
  Synthetic: EphA3
DVTFNIICKKCG

SEQ ID NO: 467 - protein, 9 aa, Artificial Sequence
  Synthetic: EZH2
FMVEDETVL

SEQ ID NO: 468 - protein, 10 aa, Artificial Sequence
  Synthetic: FGF5
NTYASPRFKF

SEQ ID NO: 469 - protein, 9 aa, Artificial Sequence
  Synthetic: glypican-3
FVGEFFTDV

SEQ ID NO: 470 - protein, 9 aa, Artificial Sequence
  Synthetic: G250 / MN / CAIX
HLSTAFARV

SEQ ID NO: 471 - protein, 9 aa, Artificial Sequence
  Synthetic: HER-2 / neu
KIFGSLAFL

SEQ ID NO: 472 - protein, 9 aa, Artificial Sequence
  Synthetic: HER-2 / neu
IISAVVGIL

SEQ ID NO: 473 - protein, 9 aa, Artificial Sequence
  Synthetic: HER-2 / neu
ALCRWGLLL

SEQ ID NO: 474 - protein, 9 aa, Artificial Sequence
  Synthetic: HER-2 / neu
ILHNGAYSL

SEQ ID NO: 475 - protein, 9 aa, Artificial Sequence
  Synthetic: HER-2 / neu
RLLQETELV

SEQ ID NO: 476 - protein, 9 aa, Artificial Sequence
  Synthetic: HER-2 / neu
VVLGVVFGI

SEQ ID NO: 477 - protein, 10 aa, Artificial Sequence
  Synthetic: HER-2 / neu
YMIMVKCWMI

SEQ ID NO: 478 - protein, 9 aa, Artificial Sequence
  Synthetic: HER-2 / neu
HLYQGCQVV

SEQ ID NO: 479 - protein, 10 aa, Artificial Sequence
  Synthetic: HER-2 / neu
YLVPQQGFFC

SEQ ID NO: 480 - protein, 9 aa, Artificial Sequence
  Synthetic: HER-2 / neu
PLQPEQLQV

SEQ ID NO: 481 - protein, 9 aa, Artificial Sequence
  Synthetic: HER-2 / neu
TLEEITGYL

SEQ ID NO: 482 - protein, 9 aa, Artificial Sequence
  Synthetic: HER-2 / neu
ALIHHNTHL

SEQ ID NO: 483 - protein, 9 aa, Artificial Sequence
  Synthetic: HER-2 / neu
PLTSIISAV

SEQ ID NO: 484 - protein, 9 aa, Artificial Sequence
  Synthetic: HER-2 / neu
VLRENTSPK

SEQ ID NO: 485 - protein, 9 aa, Artificial Sequence
  Synthetic: HER-2 / neu
TYLPTNASL

SEQ ID NO: 486 - protein, 9 aa, Artificial Sequence
  Synthetic: HLA-DOB
FLLGLIFLL

SEQ ID NO: 487 - protein, 9 aa, Artificial Sequence
  Synthetic: Hepsin
SLLSGDWVL

SEQ ID NO: 488 - protein, 9 aa, Artificial Sequence
  Synthetic: Hepsin
GLQLGVQAV

SEQ ID NO: 489 - protein, 9 aa, Artificial Sequence
  Synthetic: Hepsin
PLTEYIQPV

SEQ ID NO: 490 - protein, 9 aa, Artificial Sequence
  Synthetic: IDO1
ALLEIASCL

SEQ ID NO: 491 - protein, 9 aa, Artificial Sequence
  Synthetic: IGF2B3
NLSSAEVVV

SEQ ID NO: 492 - protein, 9 aa, Artificial Sequence
  Synthetic: IGF2B3
RLLVPTQFV

SEQ ID NO: 493 - protein, 9 aa, Artificial Sequence
  Synthetic: IL13Ralpha2
WLPFGFILI

SEQ ID NO: 494 - protein, 9 aa, Artificial Sequence
  Synthetic: Intestinal carboxyl esterase
SPRWWPTCL

SEQ ID NO: 495 - protein, 9 aa, Artificial Sequence
  Synthetic: alpha-foetoprotein
GVALQTMKQ

SEQ ID NO: 496 - protein, 9 aa, Artificial Sequence
  Synthetic: alpha-foetoprotein
FMNKFIYEI

SEQ ID NO: 497 - protein, 10 aa, Artificial Sequence
  Synthetic: alpha-foetoprotein
QLAVSVILRV

SEQ ID NO: 498 - protein, 9 aa, Artificial Sequence
  Synthetic: Kallikrein 4
FLGYLILGV

SEQ ID NO: 499 - protein, 15 aa, Artificial Sequence
  Synthetic: Kallikrein 4
SVSESDTIRSISIAS

SEQ ID NO: 500 - protein, 15 aa, Artificial Sequence
  Synthetic: Kallikrein 4
LLANGRMPTVLQCVN

SEQ ID NO: 501 - protein, 15 aa, Artificial Sequence
  Synthetic: Kallikrein 4
RMPTVLQCVNVSVVS

SEQ ID NO: 502 - protein, 9 aa, Artificial Sequence
  Synthetic: KIF20A
LLSDDDVVV

SEQ ID NO: 503 - protein, 10 aa, Artificial Sequence
  Synthetic: KIF20A
AQPDTAPLPV

SEQ ID NO: 504 - protein, 9 aa, Artificial Sequence
  Synthetic: KIF20A
CIAEQYHTV

SEQ ID NO: 505 - protein, 10 aa, Artificial Sequence
  Synthetic: Lengsin
FLPEFGISSA

SEQ ID NO: 506 - protein, 14 aa, Artificial Sequence
  Synthetic: M-CSF
LPAVVGLSPGEQEY

SEQ ID NO: 507 - protein, 16 aa, Artificial Sequence
  Synthetic: MCSP
VGQDVSVLFRVTGALQ

SEQ ID NO: 508 - protein, 8 aa, Artificial Sequence
  Synthetic: mdm-2
VLFYLGQY

SEQ ID NO: 509 - protein, 9 aa, Artificial Sequence
  Synthetic: Meloe
TLNDECWPA

SEQ ID NO: 510 - protein, 14 aa, Artificial Sequence
  Synthetic: Meloe
ERISSTLNDECWPA

SEQ ID NO: 511 - protein, 11 aa, Artificial Sequence
  Synthetic: Meloe
FGRLQGISPKI

SEQ ID NO: 512 - protein, 13 aa, Artificial Sequence
  Synthetic: Meloe
TSREQFLPSEGAA

SEQ ID NO: 513 - protein, 14 aa, Artificial Sequence
  Synthetic: Meloe
CPPWHPSERISSTL

SEQ ID NO: 514 - protein, 9 aa, Artificial Sequence
  Synthetic: Midkine
ALLALTSAV

SEQ ID NO: 515 - protein, 9 aa, Artificial Sequence
  Synthetic: Midkine
AQCQETIRV

SEQ ID NO: 516 - protein, 15 aa, Artificial Sequence
  Synthetic: Midkine
LTLLALLALTSAVAK

SEQ ID NO: 517 - protein, 10 aa, Artificial Sequence
  Synthetic: MMP-2
GLPPDVQRVH

SEQ ID NO: 518 - protein, 12 aa, Artificial Sequence
  Synthetic: MMP-7
SLFPNSPKWTSK

SEQ ID NO: 519 - protein, 9 aa, Artificial Sequence
  Synthetic: MUC1
STAPPVHNV

SEQ ID NO: 520 - protein, 9 aa, Artificial Sequence
  Synthetic: MUC1
LLLLTVLTV

SEQ ID NO: 521 - protein, 12 aa, Artificial Sequence
  Synthetic: MUC1
PGSTAPPAHGVT

SEQ ID NO: 522 - protein, 9 aa, Artificial Sequence
  Synthetic: MUC5AC
TCQPTCRSL

SEQ ID NO: 523 - protein, 9 aa, Artificial Sequence
  Synthetic: p53
LLGRNSFEV

SEQ ID NO: 524 - protein, 9 aa, Artificial Sequence
  Synthetic: p53
RMPEAAPPV

SEQ ID NO: 525 - protein, 9 aa, Artificial Sequence
  Synthetic: p53
SQKTYQGSY

SEQ ID NO: 526 - protein, 13 aa, Artificial Sequence
  Synthetic: p53
PGTRVRAMAIYKQ

SEQ ID NO: 527 - protein, 12 aa, Artificial Sequence
  Synthetic: p53
HLIRVEGNLRVE

SEQ ID NO: 528 - protein, 9 aa, Artificial Sequence
  Synthetic: PAX5
TLPGYPPHV

SEQ ID NO: 529 - protein, 12 aa, Artificial Sequence
  Synthetic: PBF
CTACRWKKACQR

SEQ ID NO: 530 - protein, 9 aa, Artificial Sequence
  Synthetic: PRAME
VLDGLDVLL

SEQ ID NO: 531 - protein, 10 aa, Artificial Sequence
  Synthetic: PRAME
SLYSFPEPEA

SEQ ID NO: 532 - protein, 10 aa, Artificial Sequence
  Synthetic: PRAME
ALYVDSLFFL

SEQ ID NO: 533 - protein, 9 aa, Artificial Sequence
  Synthetic: PRAME
SLLQHLIGL

SEQ ID NO: 534 - protein, 10 aa, Artificial Sequence
  Synthetic: PRAME
LYVDSLFFLC

SEQ ID NO: 535 - protein, 9 aa, Artificial Sequence
  Synthetic: PSMA
NYARTEDFF

SEQ ID NO: 536 - protein, 9 aa, Artificial Sequence
  Synthetic: RAGE-1
LKLSGVVRL

SEQ ID NO: 537 - protein, 11 aa, Artificial Sequence
  Synthetic: RAGE-1
PLPPARNGGLG

SEQ ID NO: 538 - protein, 10 aa, Artificial Sequence
  Synthetic: RAGE-1
SPSSNRIRNT

SEQ ID NO: 539 - protein, 9 aa, Artificial Sequence
  Synthetic: RGS5
LAALPHSCL

SEQ ID NO: 540 - protein, 10 aa, Artificial Sequence
  Synthetic: RGS5
GLASFKSFLK

SEQ ID NO: 541 - protein, 10 aa, Artificial Sequence
  Synthetic: RhoC
RAGLQVRKNK

SEQ ID NO: 542 - protein, 10 aa, Artificial Sequence
  Synthetic: RNF43
  misc_feature (10)..(10): Thr may or may not be present
ALWPWLLMAT

SEQ ID NO: 543 - protein, 9 aa, Artificial Sequence
  Synthetic: RNF43
NSQPVWLCL

SEQ ID NO: 544 - protein, 9 aa, Artificial Sequence
  Synthetic: RU2AS
LPRWPPPQL

SEQ ID NO: 545 - protein, 9 aa, Artificial Sequence
  Synthetic: secernin1
KMDAEHPEL

SEQ ID NO: 546 - protein, 9 aa, Artificial Sequence
  Synthetic: SOX10
AWISKPPGV

SEQ ID NO: 547 - protein, 10 aa, Artificial Sequence
  Synthetic: SOX10
SAWISKPPGV

SEQ ID NO: 548 - protein, 9 aa, Artificial Sequence
  Synthetic: STEAP1
MIAVFLPIV

SEQ ID NO: 549 - protein, 15 aa, Artificial Sequence
  Synthetic: STEAP1
HQQYFYKIPILVINK

SEQ ID NO: 550 - protein, 10 aa, Artificial Sequence
  Synthetic: survivin
ELTLGEFLKL

SEQ ID NO: 551 - protein, 15 aa, Artificial Sequence
  Synthetic: survivin
TLGEFLKLDRERAKN

SEQ ID NO: 552 - protein, 10 aa, Artificial Sequence
  Synthetic: Telomerase
ILAKFLHWLE

SEQ ID NO: 553 - protein, 9 aa, Artificial Sequence
  Synthetic: Telomerase
RLVDDFLLV

SEQ ID NO: 554 - protein, 15 aa, Artificial Sequence
  Synthetic: Telomerase
RPGLLGASVLGLDDI

SEQ ID NO: 555 - protein, 15 aa, Artificial Sequence
  Synthetic: Telomerase
LTDLQPYMRQFVAHL

SEQ ID NO: 556 - protein, 9 aa, Artificial Sequence
  Synthetic: TPBG
RLARLALVL

SEQ ID NO: 557 - protein, 9 aa, Artificial Sequence
  Synthetic: VEGF
SRFGGAVVR

SEQ ID NO: 558 - protein, 11 aa, Artificial Sequence
  Synthetic: WT1
TSEKRPFMCAY

SEQ ID NO: 559 - protein, 9 aa, Artificial Sequence
  Synthetic: WT1
CMTWNQMNL

SEQ ID NO: 560 - protein, 11 aa, Artificial Sequence
  Synthetic: WT1
LSHLQMHSRKH

SEQ ID NO: 561 - protein, 16 aa, Artificial Sequence
  Synthetic: WT1
KRYFKLSHLQMHSRKH

SEQ ID NO: 562 - protein, 504 aa, Artificial Sequence
  Synthetic: single chain variable fragment fusion protein
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKHHHHHH

SEQ ID NO: 563 - DNA, 290 bp, Artificial Sequence
  Synthetic: FNR Responsive Promoter
gtcagcataacaccctgacctctcattaattgttcatgccgggcggcactatcgtcgtccggccttttcctctcttactctgctacgtacatctatttctataaatccgttcaatttgtctgttttttgcacaaacatgaaatatcagacaattccgtgacttaagaaaatttatacaaatcagcaatataccccttaaggagtatataaaggtgaatttgatttacatcaataagcggggttgctgaatcgttaaggtaggcggtaatagaaaagaaatcgaggcaaaa

SEQ ID NO: 564 - DNA, 173 bp, Artificial Sequence
  Synthetic: FNR Responsive Promoter
atttcctctcatcccatccggggtgagagtcttttcccccgacttatggctcatgcatgcatcaaaaaagatgtgagcttgatcaaaaacaaaaaatatttcactcgacaggagtatttatattgcgcccgttacgtgggcttcgactgtaaatcagaaaggagaaaacacct

SEQ ID NO: 565 - DNA, 305 bp, Artificial Sequence
  Synthetic: FNR Responsive Promoter
gtcagcataacaccctgacctctcattaattgttcatgccgggcggcactatcgtcgtccggccttttcctctcttactctgctacgtacatctatttctataaatccgttcaatttgtctgttttttgcacaaacatgaaatatcagacaattccgtgacttaagaaaatttatacaaatcagcaatataccccttaaggagtatataaaggtgaatttgatttacatcaataagcggggttgctgaatcgttaaggatccctctagaaataattttgtttaactttaagaaggagatatacat

SEQ ID NO: 566 - DNA, 180 bp, Artificial Sequence
  Synthetic: FNR Responsive Promoter
catttcctctcatcccatccggggtgagagtcttttcccccgacttatggctcatgcatgcatcaaaaaagatgtgagcttgatcaaaaacaaaaaatatttcactcgacaggagtatttatattgcgcccggatccctctagaaataattttgtttaactttaagaaggagatatacat

SEQ ID NO: 567 - DNA, 199 bp, Artificial Sequence
  Synthetic: FNR Responsive Promoter
agttgttcttattggtggtgttgctttatggttgcatcgtagtaaatggttgtaacaaaagcaatttttccggctgtctgtatacaaaaacgccgtaaagtttgagcgaagtcaataaactctctacccattcagggcaatatctctcttggatccctctagaaataattttgtttaactttaagaaggagatatacat

SEQ ID NO: 568 - DNA, 117 bp, Artificial Sequence
  Synthetic: FNR-responsive regulatory region
atccccatcactcttgatggagatcaattccccaagctgctagagcgttaccttgcccttaaacattagcaatgtcgatttatcagagggccgacaggctcccacaggagaaaaccg

SEQ ID NO: 569 - DNA, 108 bp, Artificial Sequence
  Synthetic: FNR-responsive regulatory region
ctcttgatcgttatcaattcccacgctgtttcagagcgttaccttgcccttaaacattagcaatgtcgatttatcagagggccgacaggctcccacaggagaaaaccg

SEQ ID NO: 570 - DNA, 290 bp, Artificial Sequence; identical to SEQ ID NO: 563
  Synthetic: nirB1 , FNR-responsive regulatory region

SEQ ID NO: 571 - DNA, 433 bp, Artificial Sequence
  Synthetic: nirB2 , FNR-responsive regulatory region
cggcccgatcgttgaacatagcggtccgcaggcggcactgcttacagcaaacggtctgtacgctgtcgtctttgtgatgtgcttcctgttaggtttcgtcagccgtcaccgtcagcataacaccctgacctctcattaattgctcatgccggacggcactatcgtcgtccggccttttcctctcttcccccgctacgtgcatctatttctataaacccgctcattttgtctattttttgcacaaacatgaaatatcagacaattccgtgacttaagaaaatttatacaaatcagcaatatacccattaaggagtatataaaggtgaatttgatttacatcaataagcggggttgctgaatcgttaaggtaggcggtaatagaaaagaaatcgaggcaaaaatgtttgtttaactttaagaaggagatatacat

SEQ ID NO: 572 - DNA, 290 bp, Artificial Sequence
  Synthetic: nirB3 , FNR-responsive regulatory region
gtcagcataacaccctgacctctcattaattgctcatgccggacggcactatcgtcgtccggccttttcctctcttcccccgctacgtgcatctatttctataaacccgctcattttgtctattttttgcacaaacatgaaatatcagacaattccgtgacttaagaaaatttatacaaatcagcaatatacccattaaggagtatataaaggtgaatttgatttacatcaataagcggggttgctgaatcgttaaggtaggcggtaatagaaaagaaatcgaggcaaaa

SEQ ID NO: 573 - DNA, 173 bp, Artificial Sequence; identical to SEQ ID NO: 564
  Synthetic: ydfZ , FNR-responsive regulatory region

SEQ ID NO: 574 - DNA, 305 bp, Artificial Sequence; identical to SEQ ID NO: 565
  Synthetic: nirB+RBS , FNR-responsive regulatory region

SEQ ID NO: 575 - DNA, 180 bp, Artificial Sequence; identical to SEQ ID NO: 566
  Synthetic: ydfZ+RBS , FNR-responsive regulatory region

SEQ ID NO: 576 - DNA, 199 bp, Artificial Sequence; identical to SEQ ID NO: 567
  Synthetic: FNRS1 , FNR-responsive regulatory region

SEQ ID NO: 577 - DNA, 207 bp, Artificial Sequence
  Synthetic: FNRS2 , FNR-responsive regulatory region
agttgttcttattggtggtgttgctttatggttgcatcgtagtaaatggttgtaacaaaagcaatttttccggctgtctgtatacaaaaacgccgcaaagtttgagcgaagtcaataaactctctacccattcagggcaatatctctcttggatccaaagtgaactctagaaataattttgtttaactttaagaaggagatatacat

SEQ ID NO: 578 - DNA, 390 bp, Artificial Sequence
  Synthetic: nirB+crp , FNR-responsive regulatory region
tcgtctttgtgatgtgcttcctgttaggtttcgtcagccgtcaccgtcagcataacaccctgacctctcattaattgctcatgccggacggcactatcgtcgtccggccttttcctctcttcccccgctacgtgcatctatttctataaacccgctcattttgtctattttttgcacaaacatgaaatatcagacaattccgtgacttaagaaaatttatacaaatcagcaatatacccattaaggagtatataaaggtgaatttgatttacatcaataagcggggttgctgaatcgttaaggtagaaatgtgatctagttcacatttgcggtaatagaaaagaaatcgaggcaaaaatgtttgtttaactttaagaaggagatatacat

SEQ ID NO: 579 - DNA, 200 bp, Artificial Sequence
  Synthetic: FNRS+crp , FNR-responsive regulatory region
agttgttcttattggtggtgttgctttatggttgcatcgtagtaaatggttgtaacaaaagcaatttttccggctgtctgtatacaaaaacgccgcaaagtttgagcgaagtcaataaactctctacccattcagggcaatatctctcaaatgtgatctagttcacattttttgtttaactttaagaaggagatatacat

SEQ ID NO: 580 - DNA, 355 bp, Artificial Sequence
  Synthetic: katG, Regulatory sequence
tgtggcttttatgaaaatcacacagtgatcacaaattttaaacagagcacaaaatgctgcctcgaaatgagggcgggaaaataaggttatcagccttgttttctccctcattacttgaaggatatgaagctaaaacccttttttataaagcatttgtccgaattcggacataatcaaaaaagcttaattaagatcaatttgatctacatctctttaaccaacaatatgtaagatctcaactatcgcatccgtggattaattcaattataacttctctctaacgctgtgtatcgtaacggtaacactgtagaggggagcacattgatgcgaattcattaaagaggagaaaggtacc

SEQ ID NO: 581 - DNA, 228 bp, Artificial Sequence
  Synthetic: Dps, Regulatory sequence
ttccgaaaattcctggcgagcagataaataagaattgttcttatcaatatatctaactcattgaatctttattagttttgtttttcacgcttgttaccactattagtgtgataggaacagccagaatagcggaacacatagccggtgctatacttaatctcgttaattactgggacataacatcaagaggatatgaaattcgaattcattaaagaggagaaaggtacc

SEQ ID NO: 582 - DNA, 334 bp, Artificial Sequence
  Synthetic: ahpC, Regulatory sequence
gcttagatcaggtgattgccctttgtttatgagggtgttgtaatccatgtcgttgttgcatttgtaagggcaacacctcagcctgcaggcaggcactgaagataccaaagggtagttcagattacacggtcacctggaaagggggccattttactttttatcgccgctggcggtgcaaagttcacaaagttgtcttacgaaggttgtaaggtaaaacttatcgatttgataatggaaacgcattagccgaatcggcaaaaattggttaccttacatctcatcgaaaacacggaggaagtatagatgcgaattcattaaagaggagaaaggtacc

SEQ ID NO: 583 - DNA, 134 bp, Artificial Sequence
  Synthetic: oxyS Regulatory sequence
ctcgagttcattatccatcctccatcgccacgatagttcatggcgataggtagaatagcaatgaacgattatccctatcaagcattctgactgataattgctcacacgaattcattaaagaggagaaaggtacc

SEQ ID NO: 584 - DNA, 1921 bp, Artificial Sequence
  Synthetic: Prp (Propionate)
ttacccgtctggattttcagtacgcgcttttaaacgacgccacagcgtggtacggctgatccccaaataacgtgcggcggcgcgcttatcgccattaaagcgtgcgagcacctcctgcaatggaagcgcttctgctgacgagggcgtgatttctgctgtggtccccaccagttcaggtaataattgccgcataaattgtctgtccagtgttggtgcgggatcgacgcttaaaaaaagcgccaggcgttccatcatattccgcagttcgcgaatattaccgggccaatgatagttcagtagaagcggctgacactgcgtcagcccatgacgcaccgattcggtaaaagggatctccatcgcggccagcgattgttttaaaaagttttccgccagaggcagaatatcaggctgtcgctcgcgcaaggggggaagcggcagacgcagaatgctcaaacggtaaaacagatcggtacgaaaacgtccttgcgttatctcccgatccagatcgcaatgcgtggcgctgatcacccggacatctaccgggatcggctgatgcccgccaacgcgggtgacggctttttcctccagtacgcgtagaaggcgggtttgtaacggcagcggcatttcgccaatttcgtcaagaaacagcgtgccgccgtgggcgacctcaaacagccccgcacgtccacctcgtcttgagccggtaaacgctccctcctcatagccaaacagttcagcctccagcaacgactcggtaatcgcgccgcaattaacggcgacaaagggcggagaaggcttgttctgacggtggggctgacggttaaacaacgcctgatgaatcgcttgcgccgccagctctttcccggtccctgtttccccctgaatcagcactgccgcgcgggaacgggcatagagtgtaatcgtatggcgaacctgctccatttgtggtgaatcgccgaggatatcgctcagcgcataacgggtctgtaatcccttgctggaggtatgctggctatactgacgccgtgtcaggcgggtcatatccagcgcatcatggaaagcctgacgtacggtggccgctgaataaataaagatggcggtcattcctgcctcttccgccaggtcggtaattagtcctgccccaattacagcctcaatgccgttagctttgagctcgttaatttgcccgcgagcatcctcttcagtgatatagcttcgctgttcaagacggaggtgaaacgttttctgaaaggcgaccagagccggaatggtctcctgataggtcacgattcccattgaggaagtcagctttcccgcttttgccagagcctgtaatacatcgaatccgctgggtttgatgaggatgacaggtaccgacagtcggctttttaaataagcgccgttggaacctgccgcgataatcgcgtcgcagcgttcggttgccagttttttgcgaatgtaggctactgccttttcaaaaccgagctgaataggcgtgatcgtcgccagatgatcaaactccaggctgatatcccgaaatagttcgaacaggcgcgttaccgagaccgtccagatcaccggtttatcgctattatcgcgcgaagcgctatgcacagtaaccatcgtcgtagattcatgtttaaggaacgaattcttgttttatagatgtttcgttaatgttgcaatgaaacacaggcctccgtttcatgaaacgttagctgactcgtttttcttgtgactcgtctgtcagtattaaaaaagatttttcatttaactgattgtttttaaattgaattttatttaatggtttctcggtttttgggtctggcatatcccttgctttaatgagtgcatcttaattaacaattcaataacaagagggctgaatagtaatttcaacaaaataacgagcattcgaatg

SEQ ID NO: 585 - DNA, 305 bp, Artificial Sequence
  Synthetic: Arabinose Promoter region
cagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatccagcctgacgctttttttcgcaactctctactgtttctccatacctctagaaataattttgtttaactttaagaaggagatatacat

SEQ ID NO: 586 - DNA, 897 bp, Artificial Sequence
  Synthetic: AraC (reverse orientation)
ttattcacaacctgccctaaactcgctcggactcgccccggtgcattttttaaatactcgcgagaaatagagttgatcgtcaaaaccgacattgcgaccgacggtggcgataggcatccgggtggtgctcaaaagcagcttcgcctgactgatgcgctggtcctcgcgccagcttaatacgctaatccctaactgctggcggaacaaatgcgacagacgcgacggcgacaggcagacatgctgtgcgacgctggcgatatcaaaattactgtctgccaggtgatcgctgatgtactgacaagcctcgcgtacccgattatccatcggtggatggagcgactcgttaatcgcttccatgcgccgcagtaacaattgctcaagcagatttatcgccagcaattccgaatagcgcccttccccttgtccggcattaatgatttgcccaaacaggtcgctgaaatgcggctggtgcgcttcatccgggcgaaagaaaccggtattggcaaatatcgacggccagttaagccattcatgccagtaggcgcgcggacgaaagtaaacccactggtgataccattcgtgagcctccggatgacgaccgtagtgatgaatctctccaggcgggaacagcaaaatatcacccggtcggcagacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcgttaaacgagtatcccggcagcaggggatcattttgcgcttcagccatacttttcatactcccgccattcagagaagaaaccaattgtccatattgcat

SEQ ID NO: 587 - protein, 298 aa, Artificial Sequence
  Synthetic: AraC polypeptide
MQYGQLVSSLNGGSMKSMAEAQNDPLLPGYSFNAHLVAGLTPIEANGYLDFFIDRPLGMKGYILNLTIRGQGVVKNQGREFVCRPGDILLFPPGEIHHYGRHPEAHEWYHQWVYFRPRAYWHEWLNWPSIFANTGFFRPDEAHQPHFSDLFGQIINAGQGEGRYSELLAINLLEQLLLRRMEAINESLHPPMDNRVREACQYISDHLADSNFDIASVAQHVCLSPSRLSHLFRQQLGISVLSWREDQRISQAKLLLSTTRMPIATVGRNVGFDDQLYFSRVFKKCTGASPSEFRAGCE

SEQ ID NO: 588 - DNA, 280 bp, Artificial Sequence
  Synthetic: Region comprising rhamnose inducible promoter
cggtgagcatcacatcaccacaattcagcaaattgtgaacatcatcacgttcatctttccctggttgccaatggcccattttcctgtcagtaacgagaaggtcgcgaatcaggcgctttttagactggtcgtaatgaaattcagctgtcaccggatgtgctttccggtctgatgagtccgtgaggacgaaacagcctctacaaataattttgtttaaaacaacacccactaagataactctagaaataattttgtttaactttaagaaggagatatacat

SEQ ID NO: 589 - DNA, 326 bp, Artificial Sequence
  Synthetic: Lac Promoter region
attcaccaccctgaattgactctcttccgggcgctatcatgccataccgcgaaaggttttgcgccattcgatggcgcgccgcttcgtcaggccacatagctttcttgttctgatcggaacgatcgttggctgtgttgacaattaatcatcggctcgtataatgtgtggaattgtgagcgctcacaattagctgtcaccggatgtgctttccggtctgatgagtccgtgaggacgaaacagcctctacaaataattttgtttaaaacaacacccactaagataactctagaaataattttgtttaactttaagaaggagatatacat

SEQ ID NO: 590 - DNA, 1083 bp, Artificial Sequence
  Synthetic: LacI (in reverse orientation)
tcactgcccgctttccagtcgggaaacctgtcgtgccagctgcattaatgaatcggccaacgcgcggggagaggcggtttgcgtattgggcgccagggtggtttttcttttcaccagtgagactggcaacagctgattgcccttcaccgcctggccctgagagagttgcagcaagcggtccacgctggtttgccccagcaggcgaaaatcctgtttgatggtggttaacggcgggatataacatgagctatcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcctcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcat

SEQ ID NO: 591 - protein, 360 aa, Artificial Sequence
  Synthetic: LacI polypeptide sequence
MKPVTLYDVAEYAGVSYQTVSRVVNQASHVSAKTREKVEAAMAELNYIPNRVAQQLAGKQSLLIGVATSSLALHAPSQIVAAIKSRADQLGASVVVSMVERSGVEACKAAVHNLLAQRVSGLIINYPLDDQDAIAVEAACTNVPALFLDVSDQTPINSIIFSHEDGTRLGVEHLVALGHQQIALLAGPLSSVSARLRLAGWHKYLTRNQIQPIAEREGDWSAMSGFQQTMQMLNEGIVPTAMLVANDQMALGAMRAITESGLRVGADISVVGYDDTEDSSCYIPPLTTIKQDFRLLGQTSVDRLLQLSQGQAVKGNQLLPVSLVKRKTTLAPNTQTASPRALADSLMQLARQVSRLESGQ

SEQ ID NO: 592 - DNA, 222 bp, Artificial Sequence
  Synthetic: Region comprising Temperature sensitive promoter
acgttaaatctatcaccgcaagggataaatatctaacaccgtgcgtgttgactattttacctctggcggtgataatggttgcatagctgtcaccggatgtgctttccggtctgatgagtccgtgaggacgaaacagcctctacaaataattttgtttaaaacaacacccactaagataactctagaaataattttgtttaactttaagaaggagatatacat

SEQ ID NO: 593 - DNA, 714 bp, Artificial Sequence
  Synthetic: mutant cI857 repressor
tcagccaaacgtctcttcaggccactgactagcgataactttccccacaacggaacaactctcattgcatgggatcattgggtactgtgggtttagtggttgtaaaaacacctgaccgctatccctgatcagtttcttgaaggtaaactcatcacccccaagtctggctatgcagaaatcacctggctcaacagcctgctcagggtcaacgagaattaacattccgtcaggaaagcttggcttggagcctgttggtgcggtcatggaattaccttcaacctcaagccagaatgcagaatcactggcttttttggttgtgcttacccatctctccgcatcacctttggtaaaggttctaagcttaggtgagaacatccctgcctgaacatgagaaaaaacagggtactcatactcacttctaagtgacggctgcatactaaccgcttcatacatctcgtagatttctctggcgattgaagggctaaattcttcaacgctaactttgagaatttttgtaagcaatgcggcgttataagcatttaatgcattgatgccattaaataaagcaccaacgcctgactgccccatccccatcttgtctgcgacagattcctgggataagccaagttcatttttctttttttcataaattgctttaaggcgacgtgcgtcctcaagctgctcttgtgttaatggtttcttttttgtgctcat

SEQ ID NO: 594 - DNA, 43 bp, Artificial Sequence
  Synthetic: RBS and leader region
ctctagaaataattttgtttaactttaagaaggagatatacat

SEQ ID NO: 595 - protein, 237 aa, Artificial Sequence
  Synthetic: mutant cI857 repressor polypeptide sequence
MSTKKKPLTQEQLEDARRLKAIYEKKKNELGLSQESVADKMGMGQSGVGALFNGINALNAYNAALLTKILKVSVEEFSPSIAREIYEMYEAVSMQPSLRSEYEYPVFSHVQAGMFSPKLRTFTKGDAERWVSTTKKASDSAFWLEVEGNSMTAPTGSKPSFPDGMLILVDPEQAVEPGDFCIARLGGDEFTFKKLIRDSGQVFLQPLNPQYPMIPCNESCSVVGKVIASQWPEETFG

SEQ ID NO: 596 - DNA, 748 bp, Artificial Sequence
  Synthetic: TetR-Tet promoter construct
ttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaactctagaaataattttgtttaactttaagaaggagatatacat

SEQ ID NO: 597 - DNA, 225 bp, Artificial Sequence
  Synthetic: PssB promoter
tcacctttcccggattaaacgcttttttgcccggtggcatggtgctaccggcgatcacaaacggttaattatgacacaaattgacctgaatgaatatacagtattggaatgcattacccggagtgttgtgtaacaatgtctggccaggtttgtttcccggaaccgaggtcacaacatagtaaaagcgctattggtaatggtacaatcgcgcgtttacacttattc

SEQ ID NO: 598 - DNA, 30 bp, Artificial Sequence
  Synthetic: BBa_I14018
gtttatacataggcgagtactctgttatgg

SEQ ID NO: 599 - DNA, 30 bp, Artificial Sequence
  Synthetic: BBa_I14033
agaggttccaactttcaccataatgaaaca

SEQ ID NO: 600 - DNA, 30 bp, Artificial Sequence
  Synthetic: BBa_I14034
taaacaactaacggacaattctacctaaca

SEQ ID NO: 601 - DNA, 30 bp, Artificial Sequence
  Synthetic: BBa_I732021
acatcaagccaaattaaacaggattaacac

SEQ ID NO: 602 - DNA, 30 bp, Artificial Sequence
  Synthetic: BBa_I742126
gaggtaaaatagtcaacacgcacggtgtta

SEQ ID NO: 603 - DNA, 30 bp, Artificial Sequence
  Synthetic: BBa_J01006
caggccggaataactccctataatgcgcca

SEQ ID NO: 604 - DNA, 30 bp, Artificial Sequence
  Synthetic: BBa_J23100
ggctagctcagtcctaggtacagtgctagc

SEQ ID NO: 605 - DNA, 30 bp, Artificial Sequence
  Synthetic: BBa_J23101
agctagctcagtcctaggtattatgctagc

SEQ ID NO: 606 - DNA, 30 bp, Artificial Sequence
  Synthetic: BBa_J23102
agctagctcagtcctaggtactgtgctagc

SEQ ID NO: 607 - DNA, 30 bp, Artificial Sequence
  Synthetic: BBa_J23103
agctagctcagtcctagggattatgctagc

SEQ ID NO: 608 - DNA, 30 bp, Artificial Sequence
  Synthetic: BBa_J23104
agctagctcagtcctaggtattgtgctagc

SEQ ID NO: 609 - DNA, 30 bp, Artificial Sequence
  Synthetic: BBa_J23105
ggctagctcagtcctaggtactatgctagc

SEQ ID NO: 610 - DNA, 30 bp, Artificial Sequence
  Synthetic: BBa_J23106
ggctagctcagtcctaggtatagtgctagc

SEQ ID NO: 611 - DNA, 30 bp, Artificial Sequence
  Synthetic: BBa_J23107
ggctagctcagccctaggtattatgctagc

SEQ ID NO: 612 - DNA, 30 bp, Artificial Sequence
  Synthetic: BBa_J23108
agctagctcagtcctaggtataatgctagc

SEQ ID NO: 613 - DNA, 30 bp, Artificial Sequence
  Synthetic: BBa_J23109
agctagctcagtcctagggactgtgctagc

SEQ ID NO: 614 - DNA, 30 bp, Artificial Sequence
  Synthetic: BBa_J23110
ggctagctcagtcctaggtacaatgctagc

SEQ ID NO: 615 - DNA, 30 bp, Artificial Sequence; identical to SEQ ID NO: 610
  Synthetic: BBa_J23111

SEQ ID NO: 616 - DNA, 30 bp, Artificial Sequence; identical to SEQ ID NO: 607
  Synthetic: BBa_J23112

SEQ ID NO: 617 - DNA, 30 bp, Artificial Sequence
  Synthetic: BBa_J23113
ggctagctcagtcctagggattatgctagc

SEQ ID NO: 618 - DNA, 30 bp, Artificial Sequence; identical to SEQ ID NO: 614
  Synthetic: BBa_J23114

SEQ ID NO: 619 - DNA, 30 bp, Artificial Sequence
  Synthetic: BBa_J23115
agctagctcagcccttggtacaatgctagc

SEQ ID NO: 620 - DNA, 30 bp, Artificial Sequence
  Synthetic: BBa_J23116
agctagctcagtcctagggactatgctagc

SEQ ID NO: 621 - DNA, 30 bp, Artificial Sequence
  Synthetic: BBa_J23117
agctagctcagtcctagggattgtgctagc

SEQ ID NO: 622 - DNA, 30 bp, Artificial Sequence
  Synthetic: BBa_J23118
ggctagctcagtcctaggtattgtgctagc

SEQ ID NO: 623 - DNA, 30 bp, Artificial Sequence; identical to SEQ ID NO: 612
  Synthetic: BBa_J23119

SEQ ID NO: 624 - DNA, 30 bp, Artificial Sequence
  Synthetic: BBa_J23150
ggctagctcagtcctaggtattatgctagc

SEQ ID NO: 625 - DNA, 30 bp, Artificial Sequence; identical to SEQ ID NO: 614
  Synthetic: BBa_J23151

SEQ ID NO: 626 - DNA, 30 bp, Artificial Sequence
  Synthetic: BBa_J44002
aaagtgtgacgccgtgcaaataatcaatgt

SEQ ID NO: 627 - DNA, 30 bp, Artificial Sequence
  Synthetic: BBa_J48104
gacgaatacttaaaatcgtcatacttattt

SEQ ID NO: 628 - DNA, 30 bp, Artificial Sequence
  Synthetic: BBa_J54200
aaacctttcgcggtatggcatgatagcgcc

SEQ ID NO: 629 - DNA, 30 bp, Artificial Sequence
  Synthetic: BBa_J56015
tgatagcgcccggaagagagtcaattcagg

SEQ ID NO: 630 - DNA, 30 bp, Artificial Sequence
  Synthetic: BBa_J64951
ttatttaccgtgacgaactaattgctcgtg

SEQ ID NO: 631 - DNA, 30 bp, Artificial Sequence
  Synthetic: BBa_K088007
catacgccgttatacgttgtttacgctttg

SEQ ID NO: 632 - DNA, 30 bp, Artificial Sequence
  Synthetic: BBa_K119000
ttatgcttccggctcgtatgttgtgtggac

SEQ ID NO: 633 - DNA, 30 bp, Artificial Sequence
  Synthetic: BBa_K119001
ttatgcttccggctcgtatggtgtgtggac

SEQ ID NO: 634 - DNA, 30 bp, Artificial Sequence; identical to SEQ ID NO: 609
  Synthetic: BBa_K1330002

SEQ ID NO: 635 - DNA, 30 bp, Artificial Sequence
  Synthetic: BBa_K137029
atatatatatatatataatggaagcgtttt

SEQ ID NO: 636 - DNA, 30 bp, Artificial Sequence; identical to SEQ ID NO: 635
  Synthetic: BBa_K137030

SEQ ID NO: 637 - DNA, 30 bp, Artificial Sequence
  Synthetic: BBa_K137031
ccccgaaagcttaagaatataattgtaagc

SEQ ID NO: 638 - DNA, 30 bp, Artificial Sequence; identical to SEQ ID NO: 637
  Synthetic: BBa_K137032

SEQ ID NO: 639 - DNA, 30 bp, Artificial Sequence
  Synthetic: BBa_K137085
tgacaatatatatatatatataatgctagc

SEQ ID NO: 640 - DNA, 30 bp, Artificial Sequence
  Synthetic: BBa_K137086
acaatatatatatatatatataatgctagc

SEQ ID NO: 641 - DNA, 30 bp, Artificial Sequence
  Synthetic: BBa_K137087
aatatatatatatatatatataatgctagc

SEQ ID NO: 642 - DNA, 30 bp, Artificial Sequence
  Synthetic: BBa_K137088
tatatatatatatatatatataatgctagc

SEQ ID NO: 643 - DNA, 30 bp, Artificial Sequence; identical to SEQ ID NO: 642
  Synthetic: BBa_K137089

SEQ ID NO: 644 - DNA, 30 bp, Artificial Sequence
  Synthetic: BBa_K137090
aaaaaaaaaaaaaaaaaatataatgctagc

SEQ ID NO: 645 - DNA, 30 bp, Artificial Sequence; identical to SEQ ID NO: 644
  Synthetic: BBa_K137091

SEQ ID NO: 646 - DNA, 30 bp, Artificial Sequence
  Synthetic: BBa_K1585100
ggaattgtgagcggataacaatttcacaca

SEQ ID NO: 647 - DNA, 30 bp, Artificial Sequence; identical to SEQ ID NO: 646
  Synthetic: BBa_K1585101

SEQ ID NO: 648 - DNA, 30 bp, Artificial Sequence; identical to SEQ ID NO: 646
  Synthetic: BBa_K1585102

SEQ ID NO: 649 - DNA, 30 bp, Artificial Sequence; identical to SEQ ID NO: 646
  Synthetic: BBa_K1585103

SEQ ID NO: 650 - DNA, 30 bp, Artificial Sequence; identical to SEQ ID NO: 646
  Synthetic: BBa_K1585104

SEQ ID NO: 651 - DNA, 30 bp, Artificial Sequence; identical to SEQ ID NO: 646
  Synthetic: BBa_K1585105

SEQ ID NO: 652 - DNA, 30 bp, Artificial Sequence; identical to SEQ ID NO: 646
  Synthetic: BBa_K1585106

SEQ ID NO: 653 - DNA, 30 bp, Artificial Sequence; identical to SEQ ID NO: 646
  Synthetic: BBa_K1585110

SEQ ID NO: 654 - DNA, 30 bp, Artificial Sequence; identical to SEQ ID NO: 646
  Synthetic: BBa_K1585113

SEQ ID NO: 655 - DNA, 30 bp, Artificial Sequence; identical to SEQ ID NO: 646
  Synthetic: BBa_K1585115

SEQ ID NO: 656 - DNA, 30 bp, Artificial Sequence; identical to SEQ ID NO: 646
  Synthetic: BBa_K1585116

SEQ ID NO: 657 - DNA, 30 bp, Artificial Sequence; identical to SEQ ID NO: 646
  Synthetic: BBa_K1585117

SEQ ID NO: 658 - DNA, 30 bp, Artificial Sequence; identical to SEQ ID NO: 646
  Synthetic: BBa_K1585118

SEQ ID NO: 659 - DNA, 30 bp, Artificial Sequence; identical to SEQ ID NO: 646
  Synthetic: BBa_K1585119

SEQ ID NO: 660 - DNA, 30 bp, Artificial Sequence
  Synthetic: BBa_K1824896
gattaaagaggagaaatactagagtactag

SEQ ID NO: 661 - DNA, 30 bp, Artificial Sequence
  Synthetic: BBa_K256002
caccttcgggtgggcctttctgcgtttata

SEQ ID NO: 662 - DNA, 30 bp, Artificial Sequence; identical to SEQ ID NO: 661
  Synthetic: BBa_K256018

SEQ ID NO: 663 - DNA, 30 bp, Artificial Sequence; identical to SEQ ID NO: 661
  Synthetic: BBa_K256020

SEQ ID NO: 664 - DNA, 30 bp, Artificial Sequence; identical to SEQ ID NO: 661
  Synthetic: BBa_K256033

SEQ ID NO: 665 - DNA, 30 bp, Artificial Sequence; identical to SEQ ID NO: 604
  Synthetic: BBa_K292000

SEQ ID NO: 666 - DNA, 30 bp, Artificial Sequence
  Synthetic: BBa_K292001
tgctagctactagagattaaagaggagaaa

SEQ ID NO: 667 - DNA, 30 bp, Artificial Sequence
  Synthetic: BBa_K418000
ttgtgagcggataacaagatactgagcaca

SEQ ID NO: 668 - DNA, 30 bp, Artificial Sequence; identical to SEQ ID NO: 667
  Synthetic: BBa_K418002

SEQ ID NO: 669 - DNA, 30 bp, Artificial Sequence; identical to SEQ ID NO: 667
  Synthetic: BBa_K418003

SEQ ID NO: 670 - DNA, 30 bp, Artificial Sequence; identical to SEQ ID NO: 604
  Synthetic: BBa_K823004

SEQ ID NO: 671 - DNA, 30 bp, Artificial Sequence; identical to SEQ ID NO: 605
  Synthetic: BBa_K823005

SEQ ID NO: 672 - DNA, 30 bp, Artificial Sequence; identical to SEQ ID NO: 606
  Synthetic: BBa_K823006

SEQ ID NO: 673 - DNA, 30 bp, Artificial Sequence; identical to SEQ ID NO: 607
  Synthetic: BBa_K823007

SEQ ID NO: 674 - DNA, 30 bp, Artificial Sequence; identical to SEQ ID NO: 610
  Synthetic: BBa_K823008

SEQ ID NO: 675 - DNA, 30 bp, Artificial Sequence; identical to SEQ ID NO: 617
  Synthetic: BBa_K823010

SEQ ID NO: 676 - DNA, 30 bp, Artificial Sequence; identical to SEQ ID NO: 614
  Synthetic: BBa_K823011

SEQ ID NO: 677 - DNA, 30 bp, Artificial Sequence; identical to SEQ ID NO: 621
  Synthetic: BBa_K823013

SEQ ID NO: 678 - DNA, 30 bp, Artificial Sequence; identical to SEQ ID NO: 622
  Synthetic: BBa_K823014

SEQ ID NO: 679 - DNA, 30 bp, Artificial Sequence
  Synthetic: BBa_M13101
cctgtttttatgttattctctctgtaaagg

SEQ ID NO: 680 - DNA, 30 bp, Artificial Sequence
  Synthetic: BBa_M13102
aaatatttgcttatacaatcttcctgtttt

SEQ ID NO: 681 - DNA, 30 bp, Artificial Sequence
  Synthetic: BBa_M13103
gctgataaaccgatacaattaaaggctcct

SEQ ID NO: 682 - DNA, 30 bp, Artificial Sequence
  Synthetic: BBa_M13104
ctcttctcagcgtcttaatctaagctatcg

SEQ ID NO: 683 - DNA, 30 bp, Artificial Sequence
  Synthetic: BBa_M13105
atgagccagttcttaaaatcgcataaggta

SEQ ID NO: 684 - DNA, 30 bp, Artificial Sequence
  Synthetic: BBa_M13106
ctattgattgtgacaaaataaacttattcc

SEQ ID NO: 685 - DNA, 30 bp, Artificial Sequence
  Synthetic: BBa_M13108
gtttcgcgcttggtataatcgctgggggtc

SEQ ID NO: 686 - DNA, 30 bp, Artificial Sequence
  Synthetic: BBa_M13110
ctttgcttctgactataatagtcagggtaa

SEQ ID NO: 687 - DNA, 30 bp, Artificial Sequence
  Synthetic: BBa_M31519
aaaccgatacaattaaaggctcctgctagc

SEQ ID NO: 688 - DNA, 30 bp, Artificial Sequence
  Synthetic: BBa_R1074
caccacactgatagtgctagtgtagatcac

SEQ ID NO: 689 - DNA, 30 bp, Artificial Sequence
  Synthetic: BBa_R1075
gccggaataactccctataatgcgccacca

SEQ ID NO: 690 - DNA, 30 bp, Artificial Sequence
  Synthetic: BBa_S03331
ttgacaagcttttcctcagctccgtaaact

SEQ ID NO: 691 - DNA, 30 bp, Artificial Sequence
  Synthetic: BBa_J45992
ggtttcaaaattgtgatctatatttaacaa

SEQ ID NO: 692 - DNA, 30 bp, Artificial Sequence; identical to SEQ ID NO: 691
  Synthetic: BBa_J45993

SEQ ID NO: 693 - DNA, 30 bp, Artificial Sequence
  Synthetic: BBa_J45504
tctattccaataaagaaatcttcctgcgtg

SEQ ID NO: 694 - DNA, 30 bp, Artificial Sequence
  Synthetic: BBa_K1895002
gaccgaatatatagtggaaacgtttagatg

SEQ ID NO: 695 - DNA, 30 bp, Artificial Sequence
  Synthetic: BBa_K1895003
ccacatcctgtttttaaccttaaaatggca

SEQ ID NO: 696 - DNA, 30 bp, Artificial Sequence
  Synthetic: BBa_K143012
aaaaatgggctcgtgttgtacaataaatgt

SEQ ID NO: 697 - DNA, 30 bp, Artificial Sequence
  Synthetic: BBa_K143013
aaaaaaagcgcgcgattatgtaaaatataa

SEQ ID NO: 698 - DNA, 30 bp, Artificial Sequence
  Synthetic: BBa_K780003
aattgcagtaggcatgacaaaatggactca

SEQ ID NO: 699 - DNA, 30 bp, Artificial Sequence
  Synthetic: BBa_K823000
caagcttttcctttataatagaatgaatga

SEQ ID NO: 700 - DNA, 30 bp, Artificial Sequence
  Synthetic: BBa_K823002
tctaagctagtgtattttgcgtttaatagt

SEQ ID NO: 701 - DNA, 30 bp, Artificial Sequence
  Synthetic: BBa_K823003
aatgggctcgtgttgtacaataaatgtagt

SEQ ID NO: 702 - DNA, 30 bp, Artificial Sequence
  Synthetic: BBa_K143010
atccttatcgttatgggtattgtttgtaat

SEQ ID NO: 703 - DNA, 30 bp, Artificial Sequence
  Synthetic: BBa_K143011
taaaagaattgtgagcgggaatacaacaac

SEQ ID NO: 704 - DNA, 30 bp, Artificial Sequence; identical to SEQ ID NO: 697
  Synthetic: BBa_K143013

SEQ ID NO: 705 - DNA, 30 bp, Artificial Sequence
  Synthetic: BBa_K112706
tacaaaataattcccctgcaaacattatca

SEQ ID NO: 706 - DNA, 30 bp, Artificial Sequence
  Synthetic: BBa_K112707
tacaaaataattcccctgcaaacattatcg

SEQ ID NO: 707 - DNA, 30 bp, Artificial Sequence
  Synthetic: BBa_I712074
agggaatacaagctacttgttctttttgca

SEQ ID NO: 708 - DNA, 23 bp, Artificial Sequence
  Synthetic: BBa_I719005
taatacgactcactatagggaga

SEQ ID NO: 709 - DNA, 28 bp, Artificial Sequence
  Synthetic: BBa_J34814
gaatttaatacgactcactatagggaga

SEQ ID NO: 710 - DNA, 19 bp, Artificial Sequence
  Synthetic: BBa_J64997
taatacgactcactatagg

SEQ ID NO: 711 - DNA, 30 bp, Artificial Sequence
  Synthetic: BBa_K113010
gagtcgtattaatacgactcactatagggg

SEQ ID NO: 712 - DNA, 30 bp, Artificial Sequence
  Synthetic: BBa_K113011
agtgagtcgtactacgactcactatagggg

SEQ ID NO: 713 - DNA, 30 bp, Artificial Sequence
  Synthetic: BBa_K113012
gagtcgtattaatacgactctctatagggg

SEQ ID NO: 714 - DNA, 18 bp, Artificial Sequence
  Synthetic: BBa_K1614000
taatacgactcactatag

SEQ ID NO: 715 - DNA, 23 bp, Artificial Sequence
  Synthetic: BBa_R0085
taatacgactcactatagggaga

SEQ ID NO: 716 - DNA, 23 bp, Artificial Sequence
  Synthetic: BBa_R0180
ttatacgactcactatagggaga

SEQ ID NO: 717 - DNA, 23 bp, Artificial Sequence
  Synthetic: BBa_R0181
gaatacgactcactatagggaga

SEQ ID NO: 718 - DNA, 23 bp, Artificial Sequence
  Synthetic: BBa_R0182
taatacgtctcactatagggaga

SEQ ID NO: 719 - DNA, 23 bp, Artificial Sequence
  Synthetic: BBa_R0183
tcatacgactcactatagggaga

SEQ ID NO: 720 - DNA, 30 bp, Artificial Sequence
  Synthetic: BBa_Z0251
taatacgactcactatagggagaccacaac

SEQ ID NO: 721 - DNA, 30 bp, Artificial Sequence
  Synthetic: BBa_Z0252
taattgaactcactaaagggagaccacagc

SEQ ID NO: 722 - DNA, 30 bp, Artificial Sequence
  Synthetic: BBa_Z0253
cgaagtaatacgactcactattagggaaga

SEQ ID NO: 723 - DNA, 19 bp, Artificial Sequence
  Synthetic:
atttaggtgacactataga

SEQ ID NO: 724 - DNA, 30 bp, Artificial Sequence
  Synthetic: BBa_I766555
acaaacacaaatacacacactaaattaata

SEQ ID NO: 725 - DNA, 30 bp, Artificial Sequence
  Synthetic: BBa_I766556
ccaagcatacaatcaactatctcatataca

SEQ ID NO: 726 - DNA, 30 bp, Artificial Sequence
  Synthetic: BBa_I766557
gatacaggatacagcggaaacaacttttaa

SEQ ID NO: 727 - DNA, 30 bp, Artificial Sequence
  Synthetic: BBa_J63005
tttcaagctataccaagcatacaatcaact

SEQ ID NO: 728 - DNA, 30 bp, Artificial Sequence
  Synthetic: BBa_K105027
cctttgcagcataaattactatacttctat

SEQ ID NO: 729 - DNA, 30 bp, Artificial Sequence; identical to SEQ ID NO: 728
  Synthetic: BBa_K105028

SEQ ID NO: 730 - DNA, 30 bp, Artificial Sequence; identical to SEQ ID NO: 728
  Synthetic: BBa_K105029

SEQ ID NO: 731 - DNA, 30 bp, Artificial Sequence; identical to SEQ ID NO: 728
  Synthetic: BBa_K105030

SEQ ID NO: 732 - DNA, 30 bp, Artificial Sequence; identical to SEQ ID NO: 728
  Synthetic: BBa_K105031

SEQ ID NO: 733 - DNA, 30 bp, Artificial Sequence
  Synthetic: BBa_K122000
ttatctactttttacaacaaatataaaaca

SEQ ID NO: 734 - DNA, 30 bp, Artificial Sequence; identical to SEQ ID NO: 724
  Synthetic: BBa_K124000

SEQ ID NO: 735 - DNA, 30 bp, Artificial Sequence
  Synthetic: BBa_K124002
gtttcgaataaacacacataaacaaacaaa

SEQ ID NO: 736 - DNA, 30 bp, Artificial Sequence; identical to SEQ ID NO: 725
  Synthetic: BBa_K319005

SEQ ID NO: 737 - DNA, 30 bp, Artificial Sequence
  Synthetic: BBa_M31201
accatcaaaggaagctttaatcttctcata

SEQ ID NO: 738 - DNA, 30 bp, Artificial Sequence
  Synthetic: BBa_I712004
agaacccactgcttactggcttatcgaaat

SEQ ID NO: 739 - DNA, 30 bp, Artificial Sequence
  Synthetic: BBa_K076017
ggccgtttttggcttttttgttagacgaag

SEQ ID NO: 740 - DNA, 66 bp, Artificial Sequence
  Synthetic: Plpp
ataagtgccttcccatcaaaaaaatattctcaacataaaaaactttgtgtaatacttgtaacgcta

SEQ ID NO: 741 - DNA, 52 bp, Artificial Sequence
  Synthetic: PapFAB46
aaaaagagtattgacttcgcatctttttgtacctataatagattcattgcta

SEQ ID NO: 742 - DNA, 59 bp, Artificial Sequence
  Synthetic: PJ23101+UP element
ggaaaatttttttaaaaaaaaaactttacagctagctcagtcctaggtattatgctagc

SEQ ID NO: 743 - DNA, 59 bp, Artificial Sequence
  Synthetic: PJ23107+UP element
ggaaaatttttttaaaaaaaaaactttacggctagctcagccctaggtattatgctagc

SEQ ID NO: 744 - DNA, 64 bp, Artificial Sequence
  Synthetic: PSYN23119
ggaaaatttttttaaaaaaaaaacttgacagctagctcagtccttggtataatgctagcacgaa

SEQ ID NO: 745 - protein, 21 aa, Artificial Sequence
  Synthetic: PhoA
MKQSTIALALLPLLFTPVTKA

SEQ ID NO: 746 - protein, 20 aa, Artificial Sequence
  Synthetic: PhoA
KQSTIALALLPLLFTPVTKA

SEQ ID NO: 747 - protein, 22 aa, Artificial Sequence
  Synthetic: OmpF
MMKRNILAVIVPALLVAGTANA

SEQ ID NO: 748 - protein, 15 aa, Artificial Sequence
  Synthetic: cvaC
MRTLTLNELDSVSGG

SEQ ID NO: 749 - protein, 43 aa, Artificial Sequence
  Synthetic: TorA
MNNNDLFQASRRRFLAQLGGLTVAGMLGTSLLTPRRATAAQAA

SEQ ID NO: 750 - protein, 33 aa, Artificial Sequence
  Synthetic: fdnG
MDVSRRQFFKICAGGMAGTTVAALGFAPKQALA

SEQ ID NO: 751 - protein, 45 aa, Artificial Sequence
  Synthetic: dmsA
MKTKIPDAVLAAEVSRRGLVKTTAIGGLAMASSALTLPFSRIAHA

SEQ ID NO: 752 - protein, 21 aa, Artificial Sequence
  Synthetic: PelB
KYLLPTAAAGLLLLAAQPAMA

SEQ ID NO: 753 - protein, 52 aa, Artificial Sequence
  Synthetic: HlyA secretion signal
LNPLINEISKIISAAGNFDVKEERAAASLLQLSGNASDFSYGRNSITLTASA

SEQ ID NO: 754 - DNA, 159 bp, Artificial Sequence
  Synthetic: HlyA secretion signal
cttaatccattaattaatgaaatcagcaaaatcatttcagctgcaggtaattttgatgttaaagaggaaagagctgcagcttctttattgcagttgtccggtaatgccagtgatttttcatatggacggaactcaataactttgacagcatcagcataa

SEQ ID NO: 755 - DNA, 355 bp, Artificial Sequence
  Synthetic: VH (10D1)
caggtgcagctggtggagtctgggggaggcgtggtccagcctgggaggtccctgagactctcctgtgcagcctctggattcaccttcagtagctatactatgcactgggtccgccaggctccaggcaaggggctggagtgggtgacatttatatcatatgatggaaacaataaatactacgcagactccgtgaagggccgattcaccatctccagagacaattccaagaacacgctgtatctgcaaatgaacagcctgagagctgaggacacggctatatattactgtgcgaggaccggctggctggggccctttgactactggggccagggaaccctggtcaccgtctcctcag

SEQ ID NO: 756 - DNA, 325 bp, Artificial Sequence
  Synthetic: VL (10D1)
gaaattgtgttgacgcagtctccaggcaccctgtctttgtctccaggggaaagagccaccctctcctgcagggccagtcagagtgttggcagcagctacttagcctggtaccagcagaaacctggccaggctcccaggctcctcatctatggtgcattcagcagggccactggcatcccagacaggttcagtggcagtgggtctgggacagacttcactctcaccatcagcagactggagcctgaagattttgcagtgtattactgtcagcagtatggtagctcaccgtggacgttcggccaagggaccaaggtggaaatcaaac

SEQ ID NO: 757 - DNA, 355 bp, Artificial Sequence
  Synthetic: VH (4B6)
caggtgcagctggtggagtctgggggaggcgtggtccagcctgggaggtccctgagactctcctgtgcagcctctggattcaccttcagtagctatactatgcactgggtccgccaggctccaggcaaggggctggagtgggtgacatttatatcatatgatggaagcaataaacactacgcagactccgtgaagggccgattcaccgtctccagagacaattccaagaacacgctgtatctgcaaatgaacagcctgagagctgaggacacggctatatattactgtgcgaggaccggctggctggggccctttgactactggggccagggaaccctggtcaccgtctcctcag

SEQ ID NO: 758 - DNA, 325 bp, Artificial Sequence
  Synthetic: VL (4B6)
gaaattgtgttgacgcagtctccaggcaccctgtctttgtctccaggggaaagagccaccctctcctgcagggccagtcagagtgttagcagcagcttcttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgtggacgttcggccaagggaccaaggtggaaatcaaac

SEQ ID NO: 759 - DNA, 358 bp, Artificial Sequence
  Synthetic: VH (1E2)
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgttttactgtgcgagagctcccaattatattggtgcttttgatgtctggggccaagggacaatggtcaccgtctcttcag

SEQ ID NO: 760 - DNA, 322 bp, Artificial Sequence
  Synthetic: VL (1E2)
gacatccagatgacccagtctccatcctcactgtctgcatctgtaggagacagagtcaccatcacttgtcgggcgagtcagggtattagcagctggttagcctggtatcagcagaaaccagagaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacagtataatagttaccctccgacgttcggccaagggaccaaggtggaaatcaaac

SEQ ID NO: 761 - protein, 451 aa, Artificial Sequence
  Synthetic: Heavy chain (human monoclonal)
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDPRGATLYYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 762 - protein, 214 aa, Artificial Sequence; identical to SEQ ID NO: 10
  Synthetic: Light chain (human monoclonal)

SEQ ID NO: 763 - protein, 448 aa, Artificial Sequence; identical to SEQ ID NO: 5
  Synthetic: Heavy chain (human monoclonal)

SEQ ID NO: 764 - protein, 215 aa, Artificial Sequence; identical to SEQ ID NO: 7
  Synthetic: Light chain (human monoclonal)

SEQ ID NO: 765 - protein, 242 aa, Artificial Sequence
  Synthetic: anti CTLA-4 scFv; Heavy Chain  linker  Light Chain Transcribed from the native FliC promoter and 5UTR (untranslated region) with an optimized ribosome binding site
MQVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGGGSGGGSGGGSGGGEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 766 - DNA, 1103 bp, Artificial Sequence
  Synthetic: anti CTLA-4 scFv; Codon-optimized Heavy Chain  linker Light Chain Transcribed from the native FliC promoter and 5UTR (untranslated region) with an optimized ribosome binding site
agcgggaataaggggcagagaaaagagtatttcgtcgactaacaaaaaatggctgtttgtgaaaaaaattctaaaggttgttttacgacagacgataacagggttgacggcgattgagccgacgggtggaaacccaaaacgtaatcaacaaataaaaatgaggaggcaattctaatgcaagtgcaactggtagagtccggtgggggcgtggtgcagccgggtcgcagcctgcgtctgtcgtgcgcggcgagtggttttacgttttcgagttatactatgcactgggttcgtcaagcgccgggcaaaggcctggaatgggttactttcatttcttacgatggtaataataaatattatgcggattctgtgaaaggtcgctttactatttcgcgcgataacagtaaaaacactctgtatctgcaaatgaattctctgcgtgcagaggatactgctatctattactgcgcgcgtacgggctggttgggcccgtttgattattggggccaaggcactttggttactgtgtcatcgggcgggggctctggcggtggttcaggtggtggcagtggtggtggcgagatcgtgttgactcaatctccgggtactctgtctctgtctccgggtgaacgcgcgaccctgtcttgccgcgcttctcagagtgttggttcatcgtatctggcatggtatcaacagaaaccgggtcaagcgccgcgtctgctgatttacggtgcttttagtcgcgcaaccgggattccggatcgattttctggttcaggttctggcactgactttactttgactattagtcgtctggaaccggaggacttcgcggtttattattgccaacagtatggttcttctccgtggacctttggtcaaggcactaaagttgaaattaaataatcgccgtaacctgattaactgagactgacggcaacgccaaattgcctgatgcgctgcgcttatcaggcctacaaggggaattgcaatttattgaatttgcacatttttgtaggccggataaggcgtttacgccgcatccggcaacatgaatggtaatttgccagcaacgtgcttccccgccaacggcggggttttttctg

SEQ ID NO: 767 - protein, 242 aa, Artificial Sequence
  Synthetic: anti CTLA-4 scFv; Light Chain  linker  Heavy Chain Transcribed from the native FliC promoter and 5UTR (untranslated region) with an optimized ribosome binding site
MEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKGGGSGGGSGGGSGGGQVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 768 - DNA, 1103 bp, Artificial Sequence
  Synthetic: anti CTLA-4 scFv; Codon-optimized Light Chain  linker Heavy Chain Transcribed from the native FliC promoter and 5UTR (untranslated region) with an optimized ribosome binding site
agcgggaataaggggcagagaaaagagtatttcgtcgactaacaaaaaatggctgtttgtgaaaaaaattctaaaggttgttttacgacagacgataacagggttgacggcgattgagccgacgggtggaaacccaaaacgtaatcaacagattataaggagttaaatagaaaaatggagattgtactgacccagagccctggtacattgtctttgtcgcctggtgaacgcgcgactctgtcttgtcgtgcgtctcagtctgttggtagttcgtatctggcgtggtatcaacaaaaaccgggccaagctccgcgtctgctgatttacggtgcatttagccgcgcgactggcattccggaccgcttttctgggtctggctcaggtaccgattttactctgactatttcgcgtctggagccggaggatttcgcggtttattactgccagcaatatggttctagtccgtggaccttcggccaaggtactaaagtggaaatcaaaggcgggggttcgggtggtggctctgggggtggctcgggcggtgggcaggtgcaactggttgagagtggtggcggcgttgttcaaccgggccgctctctgcgcctgtcgtgcgctgcttctggctttacctttagctcttatacgatgcactgggttcgccaagctccgggtaaaggtctggagtgggtgactttcatttcttacgatggtaacaacaaatattatgctgattctgttaaaggccgttttactatttctcgagacaatagcaaaaacactctgtacctgcagatgaattctctgcgcgctgaagacaccgcgatttattattgtgcgcgcactggttggctgggtccgtttgattattggggtcagggcacgctggttactgttagctcgtgatcgccgtaacctgattaactgagactgacggcaacgccaaattgcctgatgcgctgcgcttatcaggcctacaaggggaattgcaatttattgaatttgcacatttttgtaggccggataaggcgtttacgccgcatccggcaacatgaatggtaatttgccagcaacgtgcttccccgccaacggcggggttttttctg

SEQ ID NO: 769 - protein, 236 aa, Artificial Sequence
  Synthetic: anti PD-1 scFv; Heavy Chain  linker  Light Chain Transcribed from the native FliC promoter and 5UTR (untranslated region) with an optimized ribosome binding site
MQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSGGGSGGGSGGGSGGGEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK

SEQ ID NO: 770 - DNA, 1095 bp, Artificial Sequence
  Synthetic: anti PD-1 scFv; Codon-optimized Heavy Chain  linker Light Chain Transcribed from the native FliC promoter and 5UTR (untranslated region) with an optimized ribosome binding site
agcgggaataaggggcagagaaaagagtatttcgtcgactaacaaaaaatggctgtttgtgaaaaaaattctaaaggttgttttacgacagacgataacagggttgacggcgattgagccgacgggtggaaacccaaaacgtaatcaacctcaaagaattataggaaaggaggaagcgataagtatgcaggtgcaattggtggagtcgggtggcggcgtggtgcaaccgggtcgtagcctgcgcctggattgtaaagcgtcaggcatcacgtttagcaattctggcatgcactgggtgcgtcaagcgccgggcaaaggtctggagtgggttgcggtaatttggtacgatggttctaaacgctattacgcggatagtgtgaaaggtcgctttactatctctcgcgataattctaaaaacaccctgtttctgcaaatgaattcgttgcgtgcggaagatactgcggtatattattgtgctactaacgatgattattggggtcaaggcaccctggtgactgtttcgagcggcggtggtagcggcggcggctctggtggtggttctggtggcggtgagattgtgctgactcaaagcccggcgaccctgtctctgtcgccgggtgaacgcgctactctgagttgccgtgcgtcgcaaagcgtgtcttcttatctggcgtggtaccaacaaaaaccgggtcaagcgccgcgcctgctgatatatgatgctagtaatcgtgcaacgggtattccggcacgcttttcaggttctggcagcggcaccgatttcactctgactatctcgtcactggagccggaagactttgcggtttattattgtcagcaatcttctaattggccgcgtacgtttggtcagggcactaaagttgaaatcaaataatcgccgtaacctgattaactgagactgacggcaacgccaaattgcctgatgcgctgcgcttatcaggcctacaaggggaattgcaatttattgaatttgcacatttttgtaggccggataaggcgtttacgccgcatccggcaacatgaatggtaatttgccagcaacgtgcttccccgccaacggcggggttttttctg

SEQ ID NO: 771 - protein, 236 aa, Artificial Sequence
  Synthetic: anti PD-1 scFv; Light Chain  linker  Heavy Chain Transcribed from the native FliC promoter and 5UTR (untranslated region) with an optimized ribosome binding site
MEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKGGGSGGGSGGGSGGGQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSS

SEQ ID NO: 772 - DNA, 1085 bp, Artificial Sequence
  Synthetic: anti PD-1 scFv; Codon-optimized Light Chain  linker Heavy Chain Transcribed from the native FliC promoter and 5UTR (untranslated region) with an optimized ribosome binding site
agcgggaataaggggcagagaaaagagtatttcgtcgactaacaaaaaatggctgtttgtgaaaaaaattctaaaggttgttttacgacagacgataacagggttgacggcgattgagccgacgggtggaaacccaaaacgtaatcaacatcaccaatttgaggaaaggtaaatatggaaatcgttttaacgcagtcgccggcgactctgtctttgtcgcctggtgaacgtgctacgctgtcttgccgcgcgtcacagtctgtgtcgtcatatctggcttggtaccaacagaaaccgggccaagctccgcgcctgctgatttatgatgcgtctaatcgcgcgaccggcattccggcgcgtttttctggctccggctctggcaccgactttactctgactatttcgtctctggaaccggaagattttgcggtgtactattgccagcaatcttctaattggccgcgcacgtttggtcaaggtaccaaggttgagatcaaaggtggtggctcgggcggcggttcgggcggcggctcaggtggtggccaagttcagttggttgagtctggcgggggcgtagtacaaccgggtcgttctttgcgtctggattgcaaagcgagcggtattacctttagcaattcaggtatgcactgggtgcgccaagcgccgggcaaaggcctggaatgggttgcggtgatttggtacgatggctcgaaacgttattatgctgacagcgttaaaggtcgttttactattagccgtgataattccaaaaatacgctgtttctgcagatgaatagcctgcgtgctgaagacactgcggtttattactgtgctactaatgatgattactggggccagggcaccctggtgactgtgagttcttaatcgccgtaacctgattaactgagactgacggcaacgccaaattgcctgatgcgctgcgcttatcaggcctacaaggggaattgcaatttattgaatttgcacatttttgtaggccggataaggcgtttacgccgcatccggcaacatgaatggtaatttgccagcaacgtgcttccccgccaacggcggggttttttctg

SEQ ID NO: 773 - protein, 242 aa, Artificial Sequence
  Synthetic: anti PDL-1 scFv; Heavy Chain  linker  Light Chain Transcribed from the native FliC promoter and 5UTR (untranslated region) with an optimized ribosome binding site
MEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGSGGGSGGGSGGGDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKR

SEQ ID NO: 774 - DNA, 1103 bp, Artificial Sequence
  Synthetic: anti PDL-1 scFv; Codon-optimized Heavy Chain  linker Light Chain Transcribed from the native FliC promoter and 5UTR (untranslated region) with an optimized ribosome binding site
agcgggaataaggggcagagaaaagagtatttcgtcgactaacaaaaaatggctgtttgtgaaaaaaattctaaaggttgttttacgacagacgataacagggttgacggcgattgagccgacgggtggaaacccaaaacgtaatcaactacataattttggggagggtactcgatggaagttcagctggtggagagtggtggcggtctggtgcagccgggcggctctctgcgtctgagctgtgcggcgtctggctttacgttttctgacagttggattcactgggtgcgccaagcaccgggcaaaggcctggagtgggtggcgtggatttctccgtatggcggtagtacttattatgctgattctgtgaaaggccgttttaccatttcggcggacacttcaaaaaataccgcgtatctgcaaatgaatagcctgcgcgctgaagacacggctgtttactactgtgctcgccgccactggccgggcggtttcgattattggggccaaggcactctggtgactgtgagctctggcggcgggtcgggtggcggttctggcggtggcagtggcggtggtgatattcaaatgacccaatctccgtcgtctctgagcgcgtctgtgggcgatcgtgtaaccattacttgtcgtgcgtcgcaggatgtgtctactgctgtggcgtggtatcagcaaaaaccgggtaaagctccgaaactgctgatttatagcgcttcttttctgtatagtggtgttccgtcacgttttagcggttcaggctctggtactgatttcacactgactatttcttctctgcaaccggaagatttcgcgacttattattgtcagcagtacttgtaccacccggcaacttttggtcagggcactaaagttgaaattaaacgttaatcgccgtaacctgattaactgagactgacggcaacgccaaattgcctgatgcgctgcgcttatcaggcctacaaggggaattgcaatttattgaatttgcacatttttgtaggccggataaggcgtttacgccgcatccggcaacatgaatggtaatttgccagcaacgtgcttccccgccaacggcggggttttttctg

SEQ ID NO: 775 - protein, 242 aa, Artificial Sequence
  Synthetic: anti PDL-1 scFv; Light Chain  linker  Heavy Chain Transcribed from the native FliC promoter and 5UTR (untranslated region) with an optimized ribosome binding site
MDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRGGGSGGGSGGGSGGGEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSS

SEQ ID NO: 776 - DNA, 1103 bp, Artificial Sequence
  Synthetic: anti PDL-1 scFv; Codon-optimized Light Chain  linker Heavy Chain Transcribed from the native FliC promoter and 5UTR (untranslated region) with an optimized ribosome binding site
agcgggaataaggggcagagaaaagagtatttcgtcgactaacaaaaaatggctgtttgtgaaaaaaattctaaaggttgttttacgacagacgataacagggttgacggcgattgagccgacgggtggaaacccaaaacgtaatcaactggcagacgcctaaggaggaagaccatggatattcagatgactcagagccctagctcactgtctgcgtcagttggcgatcgtgtgactattacctgtcgcgctagtcaggatgtgtctacggcggttgcgtggtatcaacagaaaccgggcaaagctccgaaactgttgatttattcagcgtctttcctgtattcgggtgtgccttctcgcttttcgggctctggtagcggtactgattttacgctgactattagttcactgcaaccggaggactttgcgacttattattgccaacaatacctgtatcacccggcgacctttggtcaaggcactaaagtggaaattaaacgcggcggcggcagcggtggcggctctggtggtgggtctggtggtggtgaggttcagctggttgagtctggtggtggtctggttcaacctgggggcagcctgcgcctgtcgtgcgcggcgtctggttttacgttctcagattcttggattcactgggtacgtcaagctccgggcaaaggtctggagtgggtggcgtggatttctccgtatggcggttcgacgtattacgcggactctgttaaagggcgttttacgatctcagcggatacttctaaaaatactgcgtatctgcaaatgaattctctgcgagcggaggataccgcggtgtattactgtgctcgccgccactggcctggtggtttcgattattggggtcaaggtaccctggtgactgtttcgtcttaatcgccgtaacctgattaactgagactgacggcaacgccaaattgcctgatgcgctgcgcttatcaggcctacaaggggaattgcaatttattgaatttgcacatttttgtaggccggataaggcgtttacgccgcatccggcaacatgaatggtaatttgccagcaacgtgcttccccgccaacggcggggttttttctg

SEQ ID NO: 777 - protein, 606 aa, Artificial Sequence
  Synthetic: anti CTLA-4 scFv
MNKVYSLKYCPVTGGLIVVSELASRVIKKTCRRLTHILLAGIPAVYLYYPQISQAGIVRQVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGGGSGGGSGGGSGGGEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKFKAEADKAAAAKADSFMNAGYKNFMTEVNNLNKRMGDLRDTNGDAGAWARIMSGAGSADGGYSDNYTHVQVGFDKKHELDGVDLFTGVTMTYTDSSADSHAFSGKTKSVGGGLYASALFESGAYIDLIGKYIHHDNDYTGNFAGLGTKHYNTHSWYAGAETGYRYHLTEETFIEPQAELVYGAVSGKTFRWKDGDMDLSMKNRDFSPLIGRTGIELGKTFSGKDWSVTARAGTSWQFDLLNNGETVLRDASGEKRIKGEKDSRMLFNVGMNAQIKDNMRFGLEFEKSAFGKYNVDNAVNANFRYMF

SEQ ID NO: 778 - DNA, 2038 bp, Artificial Sequence
  Synthetic: anti CTLA-4 scFv
atctaatctagacatcattaattcctaatttttgttgacactctatcattgatagagttattttaccactccctatcagtgatagagaaaagtgaattaaatatcaactagaggtcaccaaatgaacaaagtatatagcctgaaatattgcccagtaactgggggtctgattgtagtcagtgaactggcatcccgcgtcatcaaaaaaacctgccgtcgtctgactcacatcctgctggcgggtattccggctgtgtatctgtactacccgcagatctcccaggcaggtatcgtccgccaggtacaattagttgagagcggcggcggtgtggttcaaccgggccgtagtctgcgattgtcttgtgctgcatctggttttactttcagttcttacacgatgcactgggttcgccaagctccgggcaaaggcctggagtgggttacctttatttcttacgatggcaataataagtattacgctgattctgtgaaaggtcgctttactattagccgagataactctaaaaatactctgtatctgcaaatgaattctctgcgtgcggaagatactgcgatctattattgtgcgcgtactggttggctgggcccgtttgattattggggccaaggcacgctggttactgttagttcgggcggcggttctggtggcggctctggtggtggctctggcggcggcgagattgtgctgactcaatctccgggcacgctgtcactgtctccgggtgaacgcgcgaccctgtcttgtcgcgcgagtcaaagtgttggttcttcttatctggcttggtatcagcaaaagcctggtcaagcgccgcgtctgttgatttatggcgcgttttcgcgcgcgactggcattccggaccgattttctggttctggttctggcactgatttcactctgaccatttcacgcctggaaccggaggattttgcggtgtactattgccaacaatatggctcatcgccgtggacgtttggccaaggtactaaagttgagattaaattcaaagcggaggctgacaaggccgctgcagcaaaagctgactcctttatgaacgcgggttacaaaaacttcatgaccgaggtaaataatctcaataaacgtatgggtgatctgcgcgacactaatggggatgcaggcgcatgggcacgcattatgtctggtgcaggttcggcggatggcgggtattctgacaattacactcatgttcaggtgggcttcgataaaaaacatgagctggacggtgtggatctgttcactggcgtaaccatgacttatactgattcaagcgcagacagccacgcattttcaggtaaaacgaaatcagttggcggcggtctgtatgcgagcgcactgttcgagagcggcgcctacattgatctaattggcaagtatattcaccatgataatgattacacagggaactttgcaggcctgggcaccaaacactataacacgcattcatggtacgctggcgcagaaaccggctatagataccacctgaccgaggaaacctttatcgaaccgcaagcggaactggtttacggtgcggtcagtggcaagacctttcgttggaaagatggtgatatggatctgtcaatgaaaaaccgcgacttcagccccttgatcggccgcaccggcattgagctgggcaaaaccttctctggcaaagattggtctgttaccgcgcgtgcgggcacttcgtggcaatttgatctgctaaacaacggtgagactgtactgcgtgatgcgagtggcgaaaaacgtattaaaggtgaaaaagatagtagaatgctattcaacgtgggcatgaatgcgcagatcaaagataacatgcgttttgggttggagtttgaaaaatccgcgttcggtaaatataatgttgacaatgctgtgaacgcgaatttccgctacatgttttaactctaacggacttgagtgaggttgtaaagggagttggctcctcggtaccaaattccagaaaagaggcctcccgaaaggggggccttttttcgtttt

SEQ ID NO: 779 - protein, 606 aa, Artificial Sequence
  Synthetic: anti CTLA-4 scFv
MNKVYSLKYCPVTGGLIVVSELASRVIKKTCRRLTHILLAGIPAVYLYYPQISQAGIVREIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKGGGSGGGSGGGSGGGQVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSFKAEADKAAAAKADSFMNAGYKNFMTEVNNLNKRMGDLRDTNGDAGAWARIMSGAGSADGGYSDNYTHVQVGFDKKHELDGVDLFTGVTMTYTDSSADSHAFSGKTKSVGGGLYASALFESGAYIDLIGKYIHHDNDYTGNFAGLGTKHYNTHSWYAGAETGYRYHLTEETFIEPQAELVYGAVSGKTFRWKDGDMDLSMKNRDFSPLIGRTGIELGKTFSGKDWSVTARAGTSWQFDLLNNGETVLRDASGEKRIKGEKDSRMLFNVGMNAQIKDNMRFGLEFEKSAFGKYNVDNAVNANFRYMF

SEQ ID NO: 780 - DNA, 2038 bp, Artificial Sequence
  Synthetic: anti CTLA-4 scFv
atctaatctagacatcattaattcctaatttttgttgacactctatcattgatagagttattttaccactccctatcagtgatagagaaaagtgaattaaatatcaactagaggtcaccaaatgaacaaagtatatagcctgaaatattgcccagtaactgggggtctgattgtagtcagtgaactggcatcccgcgtcatcaaaaaaacctgccgtcgtctgactcacatcctgctggcgggtattccggctgtgtatctgtactacccgcagatctcccaggcaggtatcgtccgcgaaattgtactgacccagtcgcctggtaccctgtctctgtcgccgggtgaacgtgctaccctgtcttgtcgtgcttcgcaatcggttggctcgtcttatctggcatggtatcagcaaaaaccgggccaagcgcctcgtctgctgatttatggcgcgttttctcgtgctacgggcattcctgatcgtttttcgggctctggctctggtactgattttacgctgactatcagccgcttggaacctgaagattttgcggtttattattgccaacaatatggctcttctccgtggacgtttggtcaaggcactaaagttgaaattaaaggtggtggctcgggcggtggttctggtggtggtagtggtggtggtcaagtgcagttggttgaatcgggtggcggtgttgtgcagccgggccgttcgttgcgtctgtcttgcgcagcgagtggtttcaccttctcttcttatactatgcactgggtgcgtcaagcacctggcaaaggtctggagtgggtaacttttatttcatacgatggtaataataaatattatgcagattctgttaaaggtcgctttacgatttctcgcgataattcaaaaaatacgctgtatctgcagatgaattcgctgcgcgctgaggatactgcgatctactattgtgcgcgtactggttggctgggtccgtttgattactggggccaaggtacgctggttacagtttcgtcgttcaaagcggaggctgacaaggccgctgcagcaaaagctgactcctttatgaacgcgggttacaaaaacttcatgaccgaggtaaataatctcaataaacgtatgggtgatctgcgcgacactaatggggatgcaggcgcatgggcacgcattatgtctggtgcaggttcggcggatggcgggtattctgacaattacactcatgttcaggtgggcttcgataaaaaacatgagctggacggtgtggatctgttcactggcgtaaccatgacttatactgattcaagcgcagacagccacgcattttcaggtaaaacgaaatcagttggcggcggtctgtatgcgagcgcactgttcgagagcggcgcctacattgatctaattggcaagtatattcaccatgataatgattacacagggaactttgcaggcctgggcaccaaacactataacacgcattcatggtacgctggcgcagaaaccggctatagataccacctgaccgaggaaacctttatcgaaccgcaagcggaactggtttacggtgcggtcagtggcaagacctttcgttggaaagatggtgatatggatctgtcaatgaaaaaccgcgacttcagccccttgatcggccgcaccggcattgagctgggcaaaaccttctctggcaaagattggtctgttaccgcgcgtgcgggcacttcgtggcaatttgatctgctaaacaacggtgagactgtactgcgtgatgcgagtggcgaaaaacgtattaaaggtgaaaaagatagtagaatgctattcaacgtgggcatgaatgcgcagatcaaagataacatgcgttttgggttggagtttgaaaaatccgcgttcggtaaatataatgttgacaatgctgtgaacgcgaatttccgctacatgttttaactctaacggacttgagtgaggttgtaaagggagttggctcctcggtaccaaattccagaaaagaggcctcccgaaaggggggccttttttcgtttt

SEQ ID NO: 781 - protein, 600 aa, Artificial Sequence
  Synthetic: anti PD-1 scFv
MNKVYSLKYCPVTGGLIVVSELASRVIKKTCRRLTHILLAGIPAVYLYYPQISQAGIVRQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSGGGSGGGSGGGSGGGEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKFKAEADKAAAAKADSFMNAGYKNFMTEVNNLNKRMGDLRDTNGDAGAWARIMSGAGSADGGYSDNYTHVQVGFDKKHELDGVDLFTGVTMTYTDSSADSHAFSGKTKSVGGGLYASALFESGAYIDLIGKYIHHDNDYTGNFAGLGTKHYNTHSWYAGAETGYRYHLTEETFIEPQAELVYGAVSGKTFRWKDGDMDLSMKNRDFSPLIGRTGIELGKTFSGKDWSVTARAGTSWQFDLLNNGETVLRDASGEKRIKGEKDSRMLFNVGMNAQIKDNMRFGLEFEKSAFGKYNVDNAVNANFRYMF

SEQ ID NO: 782 - DNA, 2020 bp, Artificial Sequence
  Synthetic: anti PD-1 scFv
atctaatctagacatcattaattcctaatttttgttgacactctatcattgatagagttattttaccactccctatcagtgatagagaaaagtgaattaaatatcaactagaggtcaccaaatgaacaaagtatatagcctgaaatattgcccagtaactgggggtctgattgtagtcagtgaactggcatcccgcgtcatcaaaaaaacctgccgtcgtctgactcacatcctgctggcgggtattccggctgtgtatctgtactacccgcagatctcccaggcaggtatcgtccgccaagtacaactggttgaatccggcggaggagtggtgcaaccgggccgcagtttgcgtctggattgtaaagcttcaggcatcactttttctaattctggtatgcactgggttcgccaagctccgggtaaaggtctggagtgggttgcggtgatctggtatgatggttctaaacgatattatgcggatagtgttaagggtcgttttactatttctcgtgataattctaagaacaccttgtttctgcagatgaatagtctgcgcgctgaggatactgcggtatattattgtgcgactaatgacgattattggggccaaggcacgctggttaccgtgagctctggtggtggttcgggtggtggttctggtggtgggagcggcggtggcgagatcgttctgactcaaagcccggcgactctgagtctgagtccgggtgaacgtgcgactctgagctgccgtgcgtctcagagtgtgtcgagttatctggcgtggtaccaacaaaaaccgggccaggcgccgcgactgctgatttatgatgcttctaatcgtgcgactggtattccggcgcgctttagcggttctggctcaggcactgacttcactctgactatttcttcgctggaaccggaagattttgcggtgtactattgtcaacaatcatctaattggcctcgtacgttcggtcaaggtacaaaagtggagataaaattcaaagcggaggctgacaaggccgctgcagcaaaagctgactcctttatgaacgcgggttacaaaaacttcatgaccgaggtaaataatctcaataaacgtatgggtgatctgcgcgacactaatggggatgcaggcgcatgggcacgcattatgtctggtgcaggttcggcggatggcgggtattctgacaattacactcatgttcaggtgggcttcgataaaaaacatgagctggacggtgtggatctgttcactggcgtaaccatgacttatactgattcaagcgcagacagccacgcattttcaggtaaaacgaaatcagttggcggcggtctgtatgcgagcgcactgttcgagagcggcgcctacattgatctaattggcaagtatattcaccatgataatgattacacagggaactttgcaggcctgggcaccaaacactataacacgcattcatggtacgctggcgcagaaaccggctatagataccacctgaccgaggaaacctttatcgaaccgcaagcggaactggtttacggtgcggtcagtggcaagacctttcgttggaaagatggtgatatggatctgtcaatgaaaaaccgcgacttcagccccttgatcggccgcaccggcattgagctgggcaaaaccttctctggcaaagattggtctgttaccgcgcgtgcgggcacttcgtggcaatttgatctgctaaacaacggtgagactgtactgcgtgatgcgagtggcgaaaaacgtattaaaggtgaaaaagatagtagaatgctattcaacgtgggcatgaatgcgcagatcaaagataacatgcgttttgggttggagtttgaaaaatccgcgttcggtaaatataatgttgacaatgctgtgaacgcgaatttccgctacatgttttaactctaacggacttgagtgaggttgtaaagggagttggctcctcggtaccaaattccagaaaagaggcctcccgaaaggggggccttttttcgtttt

SEQ ID NO: 783 - protein, 600 aa, Artificial Sequence
  Synthetic: anti PD-1 scFv
MNKVYSLKYCPVTGGLIVVSELASRVIKKTCRRLTHILLAGIPAVYLYYPQISQAGIVREIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKGGGSGGGSGGGSGGGQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSFKAEADKAAAAKADSFMNAGYKNFMTEVNNLNKRMGDLRDTNGDAGAWARIMSGAGSADGGYSDNYTHVQVGFDKKHELDGVDLFTGVTMTYTDSSADSHAFSGKTKSVGGGLYASALFESGAYIDLIGKYIHHDNDYTGNFAGLGTKHYNTHSWYAGAETGYRYHLTEETFIEPQAELVYGAVSGKTFRWKDGDMDLSMKNRDFSPLIGRTGIELGKTFSGKDWSVTARAGTSWQFDLLNNGETVLRDASGEKRIKGEKDSRMLFNVGMNAQIKDNMRFGLEFEKSAFGKYNVDNAVNANFRYMF

SEQ ID NO: 784 - DNA, 2020 bp, Artificial Sequence
  Synthetic: anti PD-1 scFv
atctaatctagacatcattaattcctaatttttgttgacactctatcattgatagagttattttaccactccctatcagtgatagagaaaagtgaattaaatatcaactagaggtcaccaaatgaacaaagtatatagcctgaaatattgcccagtaactgggggtctgattgtagtcagtgaactggcatcccgcgtcatcaaaaaaacctgccgtcgtctgactcacatcctgctggcgggtattccggctgtgtatctgtactacccgcagatctcccaggcaggtatcgtccgcgaaatcgtgctgactcagagtccggcgactctgtctctgagtccgggcgaacgcgcgactctgtcttgccgtgcgtctcaatctgtgtcttcatacttggcttggtaccaacaaaaaccgggccaggcgccgcgactgttgatttatgatgcgtcgaatcgcgcgactggcattccggcgcgcttttcgggtagcggttctggtactgattttacgctgactatctcttctctggagcctgaagatttcgctgtttattactgccaacagtctagtaattggccgcgtactttcggccagggcactaaggtggaaattaaaggtggcggctcgggcggcggctcgggtggtggttctggtggtggccaagtgcaactggtggaaagtggcggcggggtggtgcaaccgggccgttctctgcgcctggattgtaaagcttcaggcattacttttagcaactctggtatgcactgggttcgccaagctccgggcaaaggcctggaatgggtggcggttatttggtacgatggctctaaacgttattacgctgacagtgttaaaggccgctttaccatttctcgtgataattctaaaaataccctgtttctgcaaatgaactcgctgcgcgcggaagatactgctgtttactattgtgcgactaatgatgattactggggtcaaggtaccctggttaccgtgtcttctttcaaagcggaggctgacaaggccgctgcagcaaaagctgactcctttatgaacgcgggttacaaaaacttcatgaccgaggtaaataatctcaataaacgtatgggtgatctgcgcgacactaatggggatgcaggcgcatgggcacgcattatgtctggtgcaggttcggcggatggcgggtattctgacaattacactcatgttcaggtgggcttcgataaaaaacatgagctggacggtgtggatctgttcactggcgtaaccatgacttatactgattcaagcgcagacagccacgcattttcaggtaaaacgaaatcagttggcggcggtctgtatgcgagcgcactgttcgagagcggcgcctacattgatctaattggcaagtatattcaccatgataatgattacacagggaactttgcaggcctgggcaccaaacactataacacgcattcatggtacgctggcgcagaaaccggctatagataccacctgaccgaggaaacctttatcgaaccgcaagcggaactggtttacggtgcggtcagtggcaagacctttcgttggaaagatggtgatatggatctgtcaatgaaaaaccgcgacttcagccccttgatcggccgcaccggcattgagctgggcaaaaccttctctggcaaagattggtctgttaccgcgcgtgcgggcacttcgtggcaatttgatctgctaaacaacggtgagactgtactgcgtgatgcgagtggcgaaaaacgtattaaaggtgaaaaagatagtagaatgctattcaacgtgggcatgaatgcgcagatcaaagataacatgcgttttgggttggagtttgaaaaatccgcgttcggtaaatataatgttgacaatgctgtgaacgcgaatttccgctacatgttttaactctaacggacttgagtgaggttgtaaagggagttggctcctcggtaccaaattccagaaaagaggcctcccgaaaggggggccttttttcgtttt

SEQ ID NO: 785 - protein, 606 aa, Artificial Sequence
  Synthetic: anti PDL-1 scFv
MNKVYSLKYCPVTGGLIVVSELASRVIKKTCRRLTHILLAGIPAVYLYYPQISQAGIVRDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRGGGSGGGSGGGSGGGEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSFKAEADKAAAAKADSFMNAGYKNFMTEVNNLNKRMGDLRDTNGDAGAWARIMSGAGSADGGYSDNYTHVQVGFDKKHELDGVDLFTGVTMTYTDSSADSHAFSGKTKSVGGGLYASALFESGAYIDLIGKYIHHDNDYTGNFAGLGTKHYNTHSWYAGAETGYRYHLTEETFIEPQAELVYGAVSGKTFRWKDGDMDLSMKNRDFSPLIGRTGIELGKTFSGKDWSVTARAGTSWQFDLLNNGETVLRDASGEKRIKGEKDSRMLFNVGMNAQIKDNMRFGLEFEKSAFGKYNVDNAVNANFRYMF

SEQ ID NO: 786 - DNA, 2038 bp, Artificial Sequence
  Synthetic: anti PDL-1 scFv
atctaatctagacatcattaattcctaatttttgttgacactctatcattgatagagttattttaccactccctatcagtgatagagaaaagtgaattaaatatcaactagaggtcaccaaatgaacaaagtatatagcctgaaatattgcccagtaactgggggtctgattgtagtcagtgaactggcatcccgcgtcatcaaaaaaacctgccgtcgtctgactcacatcctgctggcgggtattccggctgtgtatctgtactacccgcagatctcccaggcaggtatcgtccgcgaagtgcagctggtggagtcaggtggaggcttggtgcaaccgggcggttcactgcgtctgtcatgtgcggcgtctgggtttacttttagtgactcttggattcactgggtgcgccaggctccgggtaaaggcctggaatgggtagcttggattagtccttacggtggctcgacctattatgctgattcggtaaagggtcgctttactattagcgctgatacttctaaaaatactgcatacctgcagatgaatagcctgcgcgctgaggatactgctgtgtattattgcgcgcgtcgccactggccgggcggctttgattattggggccaaggtactctggttaccgtgtctagtggcggtggtagcggcggcggctcaggtggcggctcgggcggtggcgacattcagatgactcagtctccgtcttctttgtcggcgagcgtgggcgatcgtgttaccatcacgtgtcgcgcgagccaagatgtgtcgactgcggtggcttggtatcaacaaaaaccgggtaaagctccgaaactgctgatttatagtgcgtcttttttgtattctggtgttccgtctcgtttctctggctcaggtagcggtactgattttacgctgactatttcttcactgcaaccggaagattttgctacgtattattgtcaacaatatctgtatcacccggcgacgtttggtcagggtactaaggtggagataaaacgcttcaaagcggaggctgacaaggccgctgcagcaaaagctgactcctttatgaacgcgggttacaaaaacttcatgaccgaggtaaataatctcaataaacgtatgggtgatctgcgcgacactaatggggatgcaggcgcatgggcacgcattatgtctggtgcaggttcggcggatggcgggtattctgacaattacactcatgttcaggtgggcttcgataaaaaacatgagctggacggtgtggatctgttcactggcgtaaccatgacttatactgattcaagcgcagacagccacgcattttcaggtaaaacgaaatcagttggcggcggtctgtatgcgagcgcactgttcgagagcggcgcctacattgatctaattggcaagtatattcaccatgataatgattacacagggaactttgcaggcctgggcaccaaacactataacacgcattcatggtacgctggcgcagaaaccggctatagataccacctgaccgaggaaacctttatcgaaccgcaagcggaactggtttacggtgcggtcagtggcaagacctttcgttggaaagatggtgatatggatctgtcaatgaaaaaccgcgacttcagccccttgatcggccgcaccggcattgagctgggcaaaaccttctctggcaaagattggtctgttaccgcgcgtgcgggcacttcgtggcaatttgatctgctaaacaacggtgagactgtactgcgtgatgcgagtggcgaaaaacgtattaaaggtgaaaaagatagtagaatgctattcaacgtgggcatgaatgcgcagatcaaagataacatgcgttttgggttggagtttgaaaaatccgcgttcggtaaatataatgttgacaatgctgtgaacgcgaatttccgctacatgttttaactctaacggacttgagtgaggttgtaaagggagttggctcctcggtaccaaattccagaaaagaggcctcccgaaaggggggccttttttcgtttt

SEQ ID NO: 787 - protein, 600 aa, Artificial Sequence; identical to SEQ ID NO: 783
  Synthetic: anti PDL-1 scFv

SEQ ID NO: 788 - DNA, 2038 bp, Artificial Sequence
  Synthetic: anti PDL-1 scFv
atctaatctagacatcattaattcctaatttttgttgacactctatcattgatagagttattttaccactccctatcagtgatagagaaaagtgaattaaatatcaactagaggtcaccaaatgaacaaagtatatagcctgaaatattgcccagtaactgggggtctgattgtagtcagtgaactggcatcccgcgtcatcaaaaaaacctgccgtcgtctgactcacatcctgctggcgggtattccggctgtgtatctgtactacccgcagatctcccaggcaggtatcgtccgcgatattcaaatgactcaatctccgagctctctgagtgcgtctgtgggtgatcgtgtgactattacttgtcgtgcgtctcaagatgtttcaactgcggttgcgtggtatcaacagaaaccgggcaaggcgcctaagctgctgatttattctgcttcgttcctgtacagcggtgtgccgtctcgtttctctggctctggttcgggtactgatttcactctgactatttcgagtctgcagccggaagattttgcgacttattattgtcaacaatatctgtatcaccctgcgacgtttggtcaaggcacgaaagttgaaattaaacgtggtggtggctctggtggtggcagcggtggtgggtcgggtggcggtgaagttcaactggttgagtcaggtggtggcctggtgcaaccgggcggctctctgcgcctgtcttgtgctgcgtcgggttttacgttctctgatagctggattcactgggtacgccaggcaccgggcaaaggtctggaatgggtagcttggatttcaccttatggtggctctacttattacgcggatagcgtgaaaggtcgctttactatttctgcggacactagcaaaaatactgcttacctgcaaatgaattcgctgcgtgctgaggatactgcagtgtattactgtgcgcgtcgtcattggcctggcggctttgattattggggtcaaggtactctggttactgttagcagcttcaaagcggaggctgacaaggccgctgcagcaaaagctgactcctttatgaacgcgggttacaaaaacttcatgaccgaggtaaataatctcaataaacgtatgggtgatctgcgcgacactaatggggatgcaggcgcatgggcacgcattatgtctggtgcaggttcggcggatggcgggtattctgacaattacactcatgttcaggtgggcttcgataaaaaacatgagctggacggtgtggatctgttcactggcgtaaccatgacttatactgattcaagcgcagacagccacgcattttcaggtaaaacgaaatcagttggcggcggtctgtatgcgagcgcactgttcgagagcggcgcctacattgatctaattggcaagtatattcaccatgataatgattacacagggaactttgcaggcctgggcaccaaacactataacacgcattcatggtacgctggcgcagaaaccggctatagataccacctgaccgaggaaacctttatcgaaccgcaagcggaactggtttacggtgcggtcagtggcaagacctttcgttggaaagatggtgatatggatctgtcaatgaaaaaccgcgacttcagccccttgatcggccgcaccggcattgagctgggcaaaaccttctctggcaaagattggtctgttaccgcgcgtgcgggcacttcgtggcaatttgatctgctaaacaacggtgagactgtactgcgtgatgcgagtggcgaaaaacgtattaaaggtgaaaaagatagtagaatgctattcaacgtgggcatgaatgcgcagatcaaagataacatgcgttttgggttggagtttgaaaaatccgcgttcggtaaatataatgttgacaatgctgtgaacgcgaatttccgctacatgttttaactctaacggacttgagtgaggttgtaaagggagttggctcctcggtaccaaattccagaaaagaggcctcccgaaaggggggccttttttcgtttt

SEQ ID NO: 789 - protein, 294 aa, Artificial Sequence
  Synthetic: anti CTLA-4 scFv
MQVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGGGSGGGSGGGSGGGEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKLNPLINEISKIISAAGNFDVKEERAAASLLQLSGNASDFSYGRNSITLTASA

SEQ ID NO: 790 - DNA, 5309 bp, Artificial Sequence
  Synthetic: anti CTLA-4 scFv
gaattcgttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcatttatagagttaatttaccactccctatcagtgatagagaaaagtgaatacgatttaattcggaggttttttgatgcaggtacaattagttgagagcggcggcggtgtggttcaaccgggccgtagtctgcgattgtcttgtgctgcatctggttttactttcagttcttacacgatgcactgggttcgccaagctccgggcaaaggcctggagtgggttacctttatttcttacgatggcaataataagtattacgctgattctgtgaaaggtcgctttactattagccgagataactctaaaaatactctgtatctgcaaatgaattctctgcgtgcggaagatactgcgatctattattgtgcgcgtactggttggctgggcccgtttgattattggggccaaggcacgctggttactgttagttcgggcggcggttctggtggcggctctggtggtggctctggcggcggcgagattgtgctgactcaatctccgggcacgctgtcactgtctccgggtgaacgcgcgaccctgtcttgtcgcgcgagtcaaagtgttggttcttcttatctggcttggtatcagcaaaagcctggtcaagcgccgcgtctgttgatttatggcgcgttttcgcgcgcgactggcattccggaccgattttctggttctggttctggcactgatttcactctgaccatttcacgcctggaaccggaggattttgcggtgtactattgccaacaatatggctcatcgccgtggacgtttggccaaggtactaaagttgagattaaacttaatccattaattaatgaaatcagcaaaatcatttcagctgcaggtaattttgatgttaaagaggaaagagctgcagcttctttattgcagttgtccggtaatgccagtgatttttcatatggacggaactcaataactttgacagcatcagcataatttattaatttaaataatagcaatcttactgggctgtgccacataagattgctatttttttggagtcataatggattcttgtcataaaattgattatgggttatacgccctggagattttagcccaataccataacgtctctgttaacccggaagaaattaaacatagatttgacacagacgggactggtctgggattaacgtcatggttgcttgctgcgaaatctttagaactaaaggtaaaacaggtaaaaaaaacaattgaccgattaaactttatttctttgcccgcattagtctggagagaggatggacgtcattttattctgactaaagtcagtaaagaagcaaacagatatcttatttttgatctggagcaacgaaatccccgtgttctcgaacagtctgagtttgaggcgttatatcaggggcatattattcttattgcttcccgttcttctgttaccgggaaactggcaaaatttgactttacctggtttatccctgccattataaaatacagaaaaatatttattgaaacccttgttgtatctgtttttttacaattatttgcattaataaccccccttttttttcaggtggttatggacaaagtattagtacacagggggttttcaacccttaatgttattactgtcgcattatctgttgtggtggtgtttgagattatactcagcggtttaagaacttacatttttgcacatagtacaagtcggattgatgttgagttgggtgccaaactcttccggcatttactggcgctaccgatctcttattttgagagtcgtcgtgttggtgatactgttgccagggtaagagaattagaccagatccgtaattttctgacaggacaggcattaacatctgttctggacttattattttcattcatattttttgcggtaatgtggtattacagcccaaagcttactctggtgatcttattttcgctgccctgttatgctgcatggtctgtttttattagccccattttgcgacgtcgccttgatgataagttttcacggaatgcggataatcaatctttcctggtggaatcagtcacggcgattaacactataaaagctatggcagtctcacctcagatgacgaacatatgggacaaacaattggcaggatatgttgctgcaggctttaaagtgacagtattagccaccattggtcaacaaggaatacagttaatacaaaagactgttatgatcatcaacctgtggttgggagcacacctggttatttccggggatttaagtattggtcagttaattgcttttaatatgcttgctggtcagattgttgcaccggttattcgccttgcacaaatctggcaggatttccagcaggttggtatatcagttacccgccttggtgatgtgcttaactctccaactgaaagttatcatgggaaactggcattaccggaaattaatggtaatatcacttttcgtaatatccggtttcgctataagcctgactctccggttattttagataatatcaatctcagtattaagcagggggaggttattggtattgtcggacgttctggttcaggaaaaagcacattaactaaattaattcaacgtttttatattcctgaaaatggccaggtcttaattgatggacatgatcttgcgttggccgatcctaactggttacgtcgtcaggtgggggttgtgttgcaggacaatgtgctgcttaatcgcagtattattgataatatctcactggctaatcctggtatgtccgtcgaaaaagttatttatgcagcgaaattagcaggcgctcatgattttatttctgaattgcgtgaggggtataacaccattgtcggggaacagggggcaggattatccggaggtcaacgtcaacgcatcgcaattgcaagggcgctggtgaacaaccctaaaatacttatttttgatgaagcaaccagtgctctggattatgagtcggagcatatcatcatgcgcaatatgcacaaaatatgtaagggcagaacggttataatcattgctcatcgtctgtctacagtaaaaaatgcagaccgcattattgtcatggaaaaagggaaaattgttgaacagggtaaacataaggaactgctttctgaaccggaaagtttatacagttacttatatcagttacagtcagactaacagaaagaacagaagaatatgaaaacatggttaatggggttcagcgagttcctgttgcgctataaacttgtctggagtgaaacatggaaaatccggaagcaattagatactccggtacgtgaaaaggacgaaaatgaattcttacccgctcatctggaattaattgaaacgccggtatccagacggccgcgtctggttgcttattttattatggggtttctggttattgctgtcattttatctgttttaggtcaggtggaaattgttgccactgcaaatgggaaattaacactaagtgggcgcagcaaagaaattaaacctattgaaaactcaatagttaaagaaattatcgtaaaagaaggagagtcagtccggaaaggggatgtgttattaaagcttacagcactgggagctgaagctgatacgttaaaaacacagtcatcactgttacagaccaggctggaacaaactcggtatcaaattctgagcaggtcaattgaattaaataaactacctgaactgaagcttcctgatgagccttattttcagaatgtatctgaagaggaagtactgcgtttaacttctttgataaaagaacagttttccacatggcaaaatcagaagtatcaaaaagaactgaatctggataagaaaagagcagagcgattaacaatacttgcccgtataaaccgttatgaaaatttatcgagagttgaaaaaagccgtctggatgatttcaggagtttattgcataaacaggcaattgcaaaacatgctgtacttgagcaggagaataaatatgtcgaggcagcaaatgaattacgggtttataaatcgcaactggagcaaattgagagtgagatattgtctgcaaaagaagaatatcagcttgtcacgcagctttttaaaaatgaaattttagacaagctaagacaaacaacagacaacattgagttattaactctggagttagagaaaaatgaagagcgtcaacaggcttcagtaatcagggcccctgtttcgggaaaagttcagcaactgaaggttcatactgaaggtggggttgttacaacagcggaaacactgatggtcatcgttccggaagatgacacgctggaggttactgctctggtacaaaataaagatattggttttattaacgtcgggcagaatgccatcattaaagtggaggcctttccttacacccgatatggttatctggtgggtaaggtgaaaaatataaatttagatgcaatagaagaccagaaactgggactcgtttttaatgtcattgtttctgttgaagagaatgatttgtcaaccgggaataagcacattccattaagctcgggtatggctgtcactgcagaaataaagactggaatgcgaagcgtaatcagctatcttcttagtcctctggaagagtctgtaacagaaagtttacatgagcgttaagtctcagagccgcggtatccggctcatatcttctcctg

SEQ ID NO: 791 - protein, 294 aa, Artificial Sequence
  Synthetic: anti CTLA-4 scFv
MEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKGGGSGGGSGGGSGGGQVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSLNPLINEISKIISAAGNFDVKEERAAASLLQLSGNASDFSYGRNSITLTASA

SEQ ID NO: 792 - DNA, 5309 bp, Artificial Sequence
  Synthetic: anti CTLA-4 scFv
gaattcgttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcatttatagagttaatttaccactccctatcagtgatagagaaaagtgaatcacaacgctgagagagagagaaatatggaaattgtactgacccagtcgcctggtaccctgtctctgtcgccgggtgaacgtgctaccctgtcttgtcgtgcttcgcaatcggttggctcgtcttatctggcatggtatcagcaaaaaccgggccaagcgcctcgtctgctgatttatggcgcgttttctcgtgctacgggcattcctgatcgtttttcgggctctggctctggtactgattttacgctgactatcagccgcttggaacctgaagattttgcggtttattattgccaacaatatggctcttctccgtggacgtttggtcaaggcactaaagttgaaattaaaggtggtggctcgggcggtggttctggtggtggtagtggtggtggtcaagtgcagttggttgaatcgggtggcggtgttgtgcagccgggccgttcgttgcgtctgtcttgcgcagcgagtggtttcaccttctcttcttatactatgcactgggtgcgtcaagcacctggcaaaggtctggagtgggtaacttttatttcatacgatggtaataataaatattatgcagattctgttaaaggtcgctttacgatttctcgcgataattcaaaaaatacgctgtatctgcagatgaattcgctgcgcgctgaggatactgcgatctactattgtgcgcgtactggttggctgggtccgtttgattactggggccaaggtacgctggttacagtttcgtcgcttaatccattaattaatgaaatcagcaaaatcatttcagctgcaggtaattttgatgttaaagaggaaagagctgcagcttctttattgcagttgtccggtaatgccagtgatttttcatatggacggaactcaataactttgacagcatcagcataatttattaatttaaataatagcaatcttactgggctgtgccacataagattgctatttttttggagtcataatggattcttgtcataaaattgattatgggttatacgccctggagattttagcccaataccataacgtctctgttaacccggaagaaattaaacatagatttgacacagacgggactggtctgggattaacgtcatggttgcttgctgcgaaatctttagaactaaaggtaaaacaggtaaaaaaaacaattgaccgattaaactttatttctttgcccgcattagtctggagagaggatggacgtcattttattctgactaaagtcagtaaagaagcaaacagatatcttatttttgatctggagcaacgaaatccccgtgttctcgaacagtctgagtttgaggcgttatatcaggggcatattattcttattgcttcccgttcttctgttaccgggaaactggcaaaatttgactttacctggtttatccctgccattataaaatacagaaaaatatttattgaaacccttgttgtatctgtttttttacaattatttgcattaataaccccccttttttttcaggtggttatggacaaagtattagtacacagggggttttcaacccttaatgttattactgtcgcattatctgttgtggtggtgtttgagattatactcagcggtttaagaacttacatttttgcacatagtacaagtcggattgatgttgagttgggtgccaaactcttccggcatttactggcgctaccgatctcttattttgagagtcgtcgtgttggtgatactgttgccagggtaagagaattagaccagatccgtaattttctgacaggacaggcattaacatctgttctggacttattattttcattcatattttttgcggtaatgtggtattacagcccaaagcttactctggtgatcttattttcgctgccctgttatgctgcatggtctgtttttattagccccattttgcgacgtcgccttgatgataagttttcacggaatgcggataatcaatctttcctggtggaatcagtcacggcgattaacactataaaagctatggcagtctcacctcagatgacgaacatatgggacaaacaattggcaggatatgttgctgcaggctttaaagtgacagtattagccaccattggtcaacaaggaatacagttaatacaaaagactgttatgatcatcaacctgtggttgggagcacacctggttatttccggggatttaagtattggtcagttaattgcttttaatatgcttgctggtcagattgttgcaccggttattcgccttgcacaaatctggcaggatttccagcaggttggtatatcagttacccgccttggtgatgtgcttaactctccaactgaaagttatcatgggaaactggcattaccggaaattaatggtaatatcacttttcgtaatatccggtttcgctataagcctgactctccggttattttagataatatcaatctcagtattaagcagggggaggttattggtattgtcggacgttctggttcaggaaaaagcacattaactaaattaattcaacgtttttatattcctgaaaatggccaggtcttaattgatggacatgatcttgcgttggccgatcctaactggttacgtcgtcaggtgggggttgtgttgcaggacaatgtgctgcttaatcgcagtattattgataatatctcactggctaatcctggtatgtccgtcgaaaaagttatttatgcagcgaaattagcaggcgctcatgattttatttctgaattgcgtgaggggtataacaccattgtcggggaacagggggcaggattatccggaggtcaacgtcaacgcatcgcaattgcaagggcgctggtgaacaaccctaaaatacttatttttgatgaagcaaccagtgctctggattatgagtcggagcatatcatcatgcgcaatatgcacaaaatatgtaagggcagaacggttataatcattgctcatcgtctgtctacagtaaaaaatgcagaccgcattattgtcatggaaaaagggaaaattgttgaacagggtaaacataaggaactgctttctgaaccggaaagtttatacagttacttatatcagttacagtcagactaacagaaagaacagaagaatatgaaaacatggttaatggggttcagcgagttcctgttgcgctataaacttgtctggagtgaaacatggaaaatccggaagcaattagatactccggtacgtgaaaaggacgaaaatgaattcttacccgctcatctggaattaattgaaacgccggtatccagacggccgcgtctggttgcttattttattatggggtttctggttattgctgtcattttatctgttttaggtcaggtggaaattgttgccactgcaaatgggaaattaacactaagtgggcgcagcaaagaaattaaacctattgaaaactcaatagttaaagaaattatcgtaaaagaaggagagtcagtccggaaaggggatgtgttattaaagcttacagcactgggagctgaagctgatacgttaaaaacacagtcatcactgttacagaccaggctggaacaaactcggtatcaaattctgagcaggtcaattgaattaaataaactacctgaactgaagcttcctgatgagccttattttcagaatgtatctgaagaggaagtactgcgtttaacttctttgataaaagaacagttttccacatggcaaaatcagaagtatcaaaaagaactgaatctggataagaaaagagcagagcgattaacaatacttgcccgtataaaccgttatgaaaatttatcgagagttgaaaaaagccgtctggatgatttcaggagtttattgcataaacaggcaattgcaaaacatgctgtacttgagcaggagaataaatatgtcgaggcagcaaatgaattacgggtttataaatcgcaactggagcaaattgagagtgagatattgtctgcaaaagaagaatatcagcttgtcacgcagctttttaaaaatgaaattttagacaagctaagacaaacaacagacaacattgagttattaactctggagttagagaaaaatgaagagcgtcaacaggcttcagtaatcagggcccctgtttcgggaaaagttcagcaactgaaggttcatactgaaggtggggttgttacaacagcggaaacactgatggtcatcgttccggaagatgacacgctggaggttactgctctggtacaaaataaagatattggttttattaacgtcgggcagaatgccatcattaaagtggaggcctttccttacacccgatatggttatctggtgggtaaggtgaaaaatataaatttagatgcaatagaagaccagaaactgggactcgtttttaatgtcattgtttctgttgaagagaatgatttgtcaaccgggaataagcacattccattaagctcgggtatggctgtcactgcagaaataaagactggaatgcgaagcgtaatcagctatcttcttagtcctctggaagagtctgtaacagaaagtttacatgagcgttaagtctcagagccgcggtatccggctcatatcttctcctg

SEQ ID NO: 793 - protein, 288 aa, Artificial Sequence
  Synthetic: anti PD-1 scFv
MQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSGGGSGGGSGGGSGGGEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKLNPLINEISKIISAAGNFDVKEERAAASLLQLSGNASDFSYGRNSITLTASA

SEQ ID NO: 794 - DNA, 5291 bp, Artificial Sequence
  Synthetic: anti PD-1 scFv
gaattcgttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcatttatagagttaatttaccactccctatcagtgatagagaaaagtgaagttaaattgaggaggaggcagttccatgcaagtacaactggttgaatccggcggaggagtggtgcaaccgggccgcagtttgcgtctggattgtaaagcttcaggcatcactttttctaattctggtatgcactgggttcgccaagctccgggtaaaggtctggagtgggttgcggtgatctggtatgatggttctaaacgatattatgcggatagtgttaagggtcgttttactatttctcgtgataattctaagaacaccttgtttctgcagatgaatagtctgcgcgctgaggatactgcggtatattattgtgcgactaatgacgattattggggccaaggcacgctggttaccgtgagctctggtggtggttcgggtggtggttctggtggtgggagcggcggtggcgagatcgttctgactcaaagcccggcgactctgagtctgagtccgggtgaacgtgcgactctgagctgccgtgcgtctcagagtgtgtcgagttatctggcgtggtaccaacaaaaaccgggccaggcgccgcgactgctgatttatgatgcttctaatcgtgcgactggtattccggcgcgctttagcggttctggctcaggcactgacttcactctgactatttcttcgctggaaccggaagattttgcggtgtactattgtcaacaatcatctaattggcctcgtacgttcggtcaaggtacaaaagtggagataaaacttaatccattaattaatgaaatcagcaaaatcatttcagctgcaggtaattttgatgttaaagaggaaagagctgcagcttctttattgcagttgtccggtaatgccagtgatttttcatatggacggaactcaataactttgacagcatcagcataatttattaatttaaataatagcaatcttactgggctgtgccacataagattgctatttttttggagtcataatggattcttgtcataaaattgattatgggttatacgccctggagattttagcccaataccataacgtctctgttaacccggaagaaattaaacatagatttgacacagacgggactggtctgggattaacgtcatggttgcttgctgcgaaatctttagaactaaaggtaaaacaggtaaaaaaaacaattgaccgattaaactttatttctttgcccgcattagtctggagagaggatggacgtcattttattctgactaaagtcagtaaagaagcaaacagatatcttatttttgatctggagcaacgaaatccccgtgttctcgaacagtctgagtttgaggcgttatatcaggggcatattattcttattgcttcccgttcttctgttaccgggaaactggcaaaatttgactttacctggtttatccctgccattataaaatacagaaaaatatttattgaaacccttgttgtatctgtttttttacaattatttgcattaataaccccccttttttttcaggtggttatggacaaagtattagtacacagggggttttcaacccttaatgttattactgtcgcattatctgttgtggtggtgtttgagattatactcagcggtttaagaacttacatttttgcacatagtacaagtcggattgatgttgagttgggtgccaaactcttccggcatttactggcgctaccgatctcttattttgagagtcgtcgtgttggtgatactgttgccagggtaagagaattagaccagatccgtaattttctgacaggacaggcattaacatctgttctggacttattattttcattcatattttttgcggtaatgtggtattacagcccaaagcttactctggtgatcttattttcgctgccctgttatgctgcatggtctgtttttattagccccattttgcgacgtcgccttgatgataagttttcacggaatgcggataatcaatctttcctggtggaatcagtcacggcgattaacactataaaagctatggcagtctcacctcagatgacgaacatatgggacaaacaattggcaggatatgttgctgcaggctttaaagtgacagtattagccaccattggtcaacaaggaatacagttaatacaaaagactgttatgatcatcaacctgtggttgggagcacacctggttatttccggggatttaagtattggtcagttaattgcttttaatatgcttgctggtcagattgttgcaccggttattcgccttgcacaaatctggcaggatttccagcaggttggtatatcagttacccgccttggtgatgtgcttaactctccaactgaaagttatcatgggaaactggcattaccggaaattaatggtaatatcacttttcgtaatatccggtttcgctataagcctgactctccggttattttagataatatcaatctcagtattaagcagggggaggttattggtattgtcggacgttctggttcaggaaaaagcacattaactaaattaattcaacgtttttatattcctgaaaatggccaggtcttaattgatggacatgatcttgcgttggccgatcctaactggttacgtcgtcaggtgggggttgtgttgcaggacaatgtgctgcttaatcgcagtattattgataatatctcactggctaatcctggtatgtccgtcgaaaaagttatttatgcagcgaaattagcaggcgctcatgattttatttctgaattgcgtgaggggtataacaccattgtcggggaacagggggcaggattatccggaggtcaacgtcaacgcatcgcaattgcaagggcgctggtgaacaaccctaaaatacttatttttgatgaagcaaccagtgctctggattatgagtcggagcatatcatcatgcgcaatatgcacaaaatatgtaagggcagaacggttataatcattgctcatcgtctgtctacagtaaaaaatgcagaccgcattattgtcatggaaaaagggaaaattgttgaacagggtaaacataaggaactgctttctgaaccggaaagtttatacagttacttatatcagttacagtcagactaacagaaagaacagaagaatatgaaaacatggttaatggggttcagcgagttcctgttgcgctataaacttgtctggagtgaaacatggaaaatccggaagcaattagatactccggtacgtgaaaaggacgaaaatgaattcttacccgctcatctggaattaattgaaacgccggtatccagacggccgcgtctggttgcttattttattatggggtttctggttattgctgtcattttatctgttttaggtcaggtggaaattgttgccactgcaaatgggaaattaacactaagtgggcgcagcaaagaaattaaacctattgaaaactcaatagttaaagaaattatcgtaaaagaaggagagtcagtccggaaaggggatgtgttattaaagcttacagcactgggagctgaagctgatacgttaaaaacacagtcatcactgttacagaccaggctggaacaaactcggtatcaaattctgagcaggtcaattgaattaaataaactacctgaactgaagcttcctgatgagccttattttcagaatgtatctgaagaggaagtactgcgtttaacttctttgataaaagaacagttttccacatggcaaaatcagaagtatcaaaaagaactgaatctggataagaaaagagcagagcgattaacaatacttgcccgtataaaccgttatgaaaatttatcgagagttgaaaaaagccgtctggatgatttcaggagtttattgcataaacaggcaattgcaaaacatgctgtacttgagcaggagaataaatatgtcgaggcagcaaatgaattacgggtttataaatcgcaactggagcaaattgagagtgagatattgtctgcaaaagaagaatatcagcttgtcacgcagctttttaaaaatgaaattttagacaagctaagacaaacaacagacaacattgagttattaactctggagttagagaaaaatgaagagcgtcaacaggcttcagtaatcagggcccctgtttcgggaaaagttcagcaactgaaggttcatactgaaggtggggttgttacaacagcggaaacactgatggtcatcgttccggaagatgacacgctggaggttactgctctggtacaaaataaagatattggttttattaacgtcgggcagaatgccatcattaaagtggaggcctttccttacacccgatatggttatctggtgggtaaggtgaaaaatataaatttagatgcaatagaagaccagaaactgggactcgtttttaatgtcattgtttctgttgaagagaatgatttgtcaaccgggaataagcacattccattaagctcgggtatggctgtcactgcagaaataaagactggaatgcgaagcgtaatcagctatcttcttagtcctctggaagagtctgtaacagaaagtttacatgagcgttaagtctcagagccgcggtatccggctcatatcttctcctg

SEQ ID NO: 795 - protein, 288 aa, Artificial Sequence
  Synthetic: anti PD-1 scFv
MEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKGGGSGGGSGGGSGGGQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSLNPLINEISKIISAAGNFDVKEERAAASLLQLSGNASDFSYGRNSITLTASA

SEQ ID NO: 796 - DNA, 5291 bp, Artificial Sequence
  Synthetic: anti PD-1 scFv
gaattcgttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcatttatagagttaatttaccactccctatcagtgatagagaaaagtgaatataccgaacgcttaaggaggctttatggaaatcgtgctgactcagagtccggcgactctgtctctgagtccgggcgaacgcgcgactctgtcttgccgtgcgtctcaatctgtgtcttcatacttggcttggtaccaacaaaaaccgggccaggcgccgcgactgttgatttatgatgcgtcgaatcgcgcgactggcattccggcgcgcttttcgggtagcggttctggtactgattttacgctgactatctcttctctggagcctgaagatttcgctgtttattactgccaacagtctagtaattggccgcgtactttcggccagggcactaaggtggaaattaaaggtggcggctcgggcggcggctcgggtggtggttctggtggtggccaagtgcaactggtggaaagtggcggcggggtggtgcaaccgggccgttctctgcgcctggattgtaaagcttcaggcattacttttagcaactctggtatgcactgggttcgccaagctccgggcaaaggcctggaatgggtggcggttatttggtacgatggctctaaacgttattacgctgacagtgttaaaggccgctttaccatttctcgtgataattctaaaaataccctgtttctgcaaatgaactcgctgcgcgcggaagatactgctgtttactattgtgcgactaatgatgattactggggtcaaggtaccctggttaccgtgtcttctcttaatccattaattaatgaaatcagcaaaatcatttcagctgcaggtaattttgatgttaaagaggaaagagctgcagcttctttattgcagttgtccggtaatgccagtgatttttcatatggacggaactcaataactttgacagcatcagcataatttattaatttaaataatagcaatcttactgggctgtgccacataagattgctatttttttggagtcataatggattcttgtcataaaattgattatgggttatacgccctggagattttagcccaataccataacgtctctgttaacccggaagaaattaaacatagatttgacacagacgggactggtctgggattaacgtcatggttgcttgctgcgaaatctttagaactaaaggtaaaacaggtaaaaaaaacaattgaccgattaaactttatttctttgcccgcattagtctggagagaggatggacgtcattttattctgactaaagtcagtaaagaagcaaacagatatcttatttttgatctggagcaacgaaatccccgtgttctcgaacagtctgagtttgaggcgttatatcaggggcatattattcttattgcttcccgttcttctgttaccgggaaactggcaaaatttgactttacctggtttatccctgccattataaaatacagaaaaatatttattgaaacccttgttgtatctgtttttttacaattatttgcattaataaccccccttttttttcaggtggttatggacaaagtattagtacacagggggttttcaacccttaatgttattactgtcgcattatctgttgtggtggtgtttgagattatactcagcggtttaagaacttacatttttgcacatagtacaagtcggattgatgttgagttgggtgccaaactcttccggcatttactggcgctaccgatctcttattttgagagtcgtcgtgttggtgatactgttgccagggtaagagaattagaccagatccgtaattttctgacaggacaggcattaacatctgttctggacttattattttcattcatattttttgcggtaatgtggtattacagcccaaagcttactctggtgatcttattttcgctgccctgttatgctgcatggtctgtttttattagccccattttgcgacgtcgccttgatgataagttttcacggaatgcggataatcaatctttcctggtggaatcagtcacggcgattaacactataaaagctatggcagtctcacctcagatgacgaacatatgggacaaacaattggcaggatatgttgctgcaggctttaaagtgacagtattagccaccattggtcaacaaggaatacagttaatacaaaagactgttatgatcatcaacctgtggttgggagcacacctggttatttccggggatttaagtattggtcagttaattgcttttaatatgcttgctggtcagattgttgcaccggttattcgccttgcacaaatctggcaggatttccagcaggttggtatatcagttacccgccttggtgatgtgcttaactctccaactgaaagttatcatgggaaactggcattaccggaaattaatggtaatatcacttttcgtaatatccggtttcgctataagcctgactctccggttattttagataatatcaatctcagtattaagcagggggaggttattggtattgtcggacgttctggttcaggaaaaagcacattaactaaattaattcaacgtttttatattcctgaaaatggccaggtcttaattgatggacatgatcttgcgttggccgatcctaactggttacgtcgtcaggtgggggttgtgttgcaggacaatgtgctgcttaatcgcagtattattgataatatctcactggctaatcctggtatgtccgtcgaaaaagttatttatgcagcgaaattagcaggcgctcatgattttatttctgaattgcgtgaggggtataacaccattgtcggggaacagggggcaggattatccggaggtcaacgtcaacgcatcgcaattgcaagggcgctggtgaacaaccctaaaatacttatttttgatgaagcaaccagtgctctggattatgagtcggagcatatcatcatgcgcaatatgcacaaaatatgtaagggcagaacggttataatcattgctcatcgtctgtctacagtaaaaaatgcagaccgcattattgtcatggaaaaagggaaaattgttgaacagggtaaacataaggaactgctttctgaaccggaaagtttatacagttacttatatcagttacagtcagactaacagaaagaacagaagaatatgaaaacatggttaatggggttcagcgagttcctgttgcgctataaacttgtctggagtgaaacatggaaaatccggaagcaattagatactccggtacgtgaaaaggacgaaaatgaattcttacccgctcatctggaattaattgaaacgccggtatccagacggccgcgtctggttgcttattttattatggggtttctggttattgctgtcattttatctgttttaggtcaggtggaaattgttgccactgcaaatgggaaattaacactaagtgggcgcagcaaagaaattaaacctattgaaaactcaatagttaaagaaattatcgtaaaagaaggagagtcagtccggaaaggggatgtgttattaaagcttacagcactgggagctgaagctgatacgttaaaaacacagtcatcactgttacagaccaggctggaacaaactcggtatcaaattctgagcaggtcaattgaattaaataaactacctgaactgaagcttcctgatgagccttattttcagaatgtatctgaagaggaagtactgcgtttaacttctttgataaaagaacagttttccacatggcaaaatcagaagtatcaaaaagaactgaatctggataagaaaagagcagagcgattaacaatacttgcccgtataaaccgttatgaaaatttatcgagagttgaaaaaagccgtctggatgatttcaggagtttattgcataaacaggcaattgcaaaacatgctgtacttgagcaggagaataaatatgtcgaggcagcaaatgaattacgggtttataaatcgcaactggagcaaattgagagtgagatattgtctgcaaaagaagaatatcagcttgtcacgcagctttttaaaaatgaaattttagacaagctaagacaaacaacagacaacattgagttattaactctggagttagagaaaaatgaagagcgtcaacaggcttcagtaatcagggcccctgtttcgggaaaagttcagcaactgaaggttcatactgaaggtggggttgttacaacagcggaaacactgatggtcatcgttccggaagatgacacgctggaggttactgctctggtacaaaataaagatattggttttattaacgtcgggcagaatgccatcattaaagtggaggcctttccttacacccgatatggttatctggtgggtaaggtgaaaaatataaatttagatgcaatagaagaccagaaactgggactcgtttttaatgtcattgtttctgttgaagagaatgatttgtcaaccgggaataagcacattccattaagctcgggtatggctgtcactgcagaaataaagactggaatgcgaagcgtaatcagctatcttcttagtcctctggaagagtctgtaacagaaagtttacatgagcgttaagtctcagagccgcggtatccggctcatatcttctcctg

SEQ ID NO: 797 - protein, 294 aa, Artificial Sequence
  Synthetic: anti PDL-1 scFv
MEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGSGGGSGGGSGGGDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRLNPLINEISKIISAAGNFDVKEERAAASLLQLSGNASDFSYGRNSITLTASA

SEQ ID NO: 798 - DNA, 5309 bp, Artificial Sequence
  Synthetic: anti PDL-1 scFv
gaattcgttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcatttatagagttaatttaccactccctatcagtgatagagaaaagtgaagatagggaccaggtaaggaggatgaatggaagtgcagctggtggagtcaggtggaggcttggtgcaaccgggcggttcactgcgtctgtcatgtgcggcgtctgggtttacttttagtgactcttggattcactgggtgcgccaggctccgggtaaaggcctggaatgggtagcttggattagtccttacggtggctcgacctattatgctgattcggtaaagggtcgctttactattagcgctgatacttctaaaaatactgcatacctgcagatgaatagcctgcgcgctgaggatactgctgtgtattattgcgcgcgtcgccactggccgggcggctttgattattggggccaaggtactctggttaccgtgtctagtggcggtggtagcggcggcggctcaggtggcggctcgggcggtggcgacattcagatgactcagtctccgtcttctttgtcggcgagcgtgggcgatcgtgttaccatcacgtgtcgcgcgagccaagatgtgtcgactgcggtggcttggtatcaacaaaaaccgggtaaagctccgaaactgctgatttatagtgcgtcttttttgtattctggtgttccgtctcgtttctctggctcaggtagcggtactgattttacgctgactatttcttcactgcaaccggaagattttgctacgtattattgtcaacaatatctgtatcacccggcgacgtttggtcagggtactaaggtggagataaaacgccttaatccattaattaatgaaatcagcaaaatcatttcagctgcaggtaattttgatgttaaagaggaaagagctgcagcttctttattgcagttgtccggtaatgccagtgatttttcatatggacggaactcaataactttgacagcatcagcataatttattaatttaaataatagcaatcttactgggctgtgccacataagattgctatttttttggagtcataatggattcttgtcataaaattgattatgggttatacgccctggagattttagcccaataccataacgtctctgttaacccggaagaaattaaacatagatttgacacagacgggactggtctgggattaacgtcatggttgcttgctgcgaaatctttagaactaaaggtaaaacaggtaaaaaaaacaattgaccgattaaactttatttctttgcccgcattagtctggagagaggatggacgtcattttattctgactaaagtcagtaaagaagcaaacagatatcttatttttgatctggagcaacgaaatccccgtgttctcgaacagtctgagtttgaggcgttatatcaggggcatattattcttattgcttcccgttcttctgttaccgggaaactggcaaaatttgactttacctggtttatccctgccattataaaatacagaaaaatatttattgaaacccttgttgtatctgtttttttacaattatttgcattaataaccccccttttttttcaggtggttatggacaaagtattagtacacagggggttttcaacccttaatgttattactgtcgcattatctgttgtggtggtgtttgagattatactcagcggtttaagaacttacatttttgcacatagtacaagtcggattgatgttgagttgggtgccaaactcttccggcatttactggcgctaccgatctcttattttgagagtcgtcgtgttggtgatactgttgccagggtaagagaattagaccagatccgtaattttctgacaggacaggcattaacatctgttctggacttattattttcattcatattttttgcggtaatgtggtattacagcccaaagcttactctggtgatcttattttcgctgccctgttatgctgcatggtctgtttttattagccccattttgcgacgtcgccttgatgataagttttcacggaatgcggataatcaatctttcctggtggaatcagtcacggcgattaacactataaaagctatggcagtctcacctcagatgacgaacatatgggacaaacaattggcaggatatgttgctgcaggctttaaagtgacagtattagccaccattggtcaacaaggaatacagttaatacaaaagactgttatgatcatcaacctgtggttgggagcacacctggttatttccggggatttaagtattggtcagttaattgcttttaatatgcttgctggtcagattgttgcaccggttattcgccttgcacaaatctggcaggatttccagcaggttggtatatcagttacccgccttggtgatgtgcttaactctccaactgaaagttatcatgggaaactggcattaccggaaattaatggtaatatcacttttcgtaatatccggtttcgctataagcctgactctccggttattttagataatatcaatctcagtattaagcagggggaggttattggtattgtcggacgttctggttcaggaaaaagcacattaactaaattaattcaacgtttttatattcctgaaaatggccaggtcttaattgatggacatgatcttgcgttggccgatcctaactggttacgtcgtcaggtgggggttgtgttgcaggacaatgtgctgcttaatcgcagtattattgataatatctcactggctaatcctggtatgtccgtcgaaaaagttatttatgcagcgaaattagcaggcgctcatgattttatttctgaattgcgtgaggggtataacaccattgtcggggaacagggggcaggattatccggaggtcaacgtcaacgcatcgcaattgcaagggcgctggtgaacaaccctaaaatacttatttttgatgaagcaaccagtgctctggattatgagtcggagcatatcatcatgcgcaatatgcacaaaatatgtaagggcagaacggttataatcattgctcatcgtctgtctacagtaaaaaatgcagaccgcattattgtcatggaaaaagggaaaattgttgaacagggtaaacataaggaactgctttctgaaccggaaagtttatacagttacttatatcagttacagtcagactaacagaaagaacagaagaatatgaaaacatggttaatggggttcagcgagttcctgttgcgctataaacttgtctggagtgaaacatggaaaatccggaagcaattagatactccggtacgtgaaaaggacgaaaatgaattcttacccgctcatctggaattaattgaaacgccggtatccagacggccgcgtctggttgcttattttattatggggtttctggttattgctgtcattttatctgttttaggtcaggtggaaattgttgccactgcaaatgggaaattaacactaagtgggcgcagcaaagaaattaaacctattgaaaactcaatagttaaagaaattatcgtaaaagaaggagagtcagtccggaaaggggatgtgttattaaagcttacagcactgggagctgaagctgatacgttaaaaacacagtcatcactgttacagaccaggctggaacaaactcggtatcaaattctgagcaggtcaattgaattaaataaactacctgaactgaagcttcctgatgagccttattttcagaatgtatctgaagaggaagtactgcgtttaacttctttgataaaagaacagttttccacatggcaaaatcagaagtatcaaaaagaactgaatctggataagaaaagagcagagcgattaacaatacttgcccgtataaaccgttatgaaaatttatcgagagttgaaaaaagccgtctggatgatttcaggagtttattgcataaacaggcaattgcaaaacatgctgtacttgagcaggagaataaatatgtcgaggcagcaaatgaattacgggtttataaatcgcaactggagcaaattgagagtgagatattgtctgcaaaagaagaatatcagcttgtcacgcagctttttaaaaatgaaattttagacaagctaagacaaacaacagacaacattgagttattaactctggagttagagaaaaatgaagagcgtcaacaggcttcagtaatcagggcccctgtttcgggaaaagttcagcaactgaaggttcatactgaaggtggggttgttacaacagcggaaacactgatggtcatcgttccggaagatgacacgctggaggttactgctctggtacaaaataaagatattggttttattaacgtcgggcagaatgccatcattaaagtggaggcctttccttacacccgatatggttatctggtgggtaaggtgaaaaatataaatttagatgcaatagaagaccagaaactgggactcgtttttaatgtcattgtttctgttgaagagaatgatttgtcaaccgggaataagcacattccattaagctcgggtatggctgtcactgcagaaataaagactggaatgcgaagcgtaatcagctatcttcttagtcctctggaagagtctgtaacagaaagtttacatgagcgttaagtctcagagccgcggtatccggctcatatcttctcctg

SEQ ID NO: 799 - protein, 294 aa, Artificial Sequence
  Synthetic: anti PDL-1 scFv
MDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRGGGSGGGSGGGSGGGEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSLNPLINEISKIISAAGNFDVKEERAAASLLQLSGNASDFSYGRNSITLTASA

SEQ ID NO: 800 - DNA, 5309 bp, Artificial Sequence
  Synthetic: anti PDL-1 scFv
gaattcgttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcatttatagagttaatttaccactccctatcagtgatagagaaaagtgaaataaatcccttcatgaggaggtaagatggatattcaaatgactcaatctccgagctctctgagtgcgtctgtgggtgatcgtgtgactattacttgtcgtgcgtctcaagatgtttcaactgcggttgcgtggtatcaacagaaaccgggcaaggcgcctaagctgctgatttattctgcttcgttcctgtacagcggtgtgccgtctcgtttctctggctctggttcgggtactgatttcactctgactatttcgagtctgcagccggaagattttgcgacttattattgtcaacaatatctgtatcaccctgcgacgtttggtcaaggcacgaaagttgaaattaaacgtggtggtggctctggtggtggcagcggtggtgggtcgggtggcggtgaagttcaactggttgagtcaggtggtggcctggtgcaaccgggcggctctctgcgcctgtcttgtgctgcgtcgggttttacgttctctgatagctggattcactgggtacgccaggcaccgggcaaaggtctggaatgggtagcttggatttcaccttatggtggctctacttattacgcggatagcgtgaaaggtcgctttactatttctgcggacactagcaaaaatactgcttacctgcaaatgaattcgctgcgtgctgaggatactgcagtgtattactgtgcgcgtcgtcattggcctggcggctttgattattggggtcaaggtactctggttactgttagcagccttaatccattaattaatgaaatcagcaaaatcatttcagctgcaggtaattttgatgttaaagaggaaagagctgcagcttctttattgcagttgtccggtaatgccagtgatttttcatatggacggaactcaataactttgacagcatcagcataatttattaatttaaataatagcaatcttactgggctgtgccacataagattgctatttttttggagtcataatggattcttgtcataaaattgattatgggttatacgccctggagattttagcccaataccataacgtctctgttaacccggaagaaattaaacatagatttgacacagacgggactggtctgggattaacgtcatggttgcttgctgcgaaatctttagaactaaaggtaaaacaggtaaaaaaaacaattgaccgattaaactttatttctttgcccgcattagtctggagagaggatggacgtcattttattctgactaaagtcagtaaagaagcaaacagatatcttatttttgatctggagcaacgaaatccccgtgttctcgaacagtctgagtttgaggcgttatatcaggggcatattattcttattgcttcccgttcttctgttaccgggaaactggcaaaatttgactttacctggtttatccctgccattataaaatacagaaaaatatttattgaaacccttgttgtatctgtttttttacaattatttgcattaataaccccccttttttttcaggtggttatggacaaagtattagtacacagggggttttcaacccttaatgttattactgtcgcattatctgttgtggtggtgtttgagattatactcagcggtttaagaacttacatttttgcacatagtacaagtcggattgatgttgagttgggtgccaaactcttccggcatttactggcgctaccgatctcttattttgagagtcgtcgtgttggtgatactgttgccagggtaagagaattagaccagatccgtaattttctgacaggacaggcattaacatctgttctggacttattattttcattcatattttttgcggtaatgtggtattacagcccaaagcttactctggtgatcttattttcgctgccctgttatgctgcatggtctgtttttattagccccattttgcgacgtcgccttgatgataagttttcacggaatgcggataatcaatctttcctggtggaatcagtcacggcgattaacactataaaagctatggcagtctcacctcagatgacgaacatatgggacaaacaattggcaggatatgttgctgcaggctttaaagtgacagtattagccaccattggtcaacaaggaatacagttaatacaaaagactgttatgatcatcaacctgtggttgggagcacacctggttatttccggggatttaagtattggtcagttaattgcttttaatatgcttgctggtcagattgttgcaccggttattcgccttgcacaaatctggcaggatttccagcaggttggtatatcagttacccgccttggtgatgtgcttaactctccaactgaaagttatcatgggaaactggcattaccggaaattaatggtaatatcacttttcgtaatatccggtttcgctataagcctgactctccggttattttagataatatcaatctcagtattaagcagggggaggttattggtattgtcggacgttctggttcaggaaaaagcacattaactaaattaattcaacgtttttatattcctgaaaatggccaggtcttaattgatggacatgatcttgcgttggccgatcctaactggttacgtcgtcaggtgggggttgtgttgcaggacaatgtgctgcttaatcgcagtattattgataatatctcactggctaatcctggtatgtccgtcgaaaaagttatttatgcagcgaaattagcaggcgctcatgattttatttctgaattgcgtgaggggtataacaccattgtcggggaacagggggcaggattatccggaggtcaacgtcaacgcatcgcaattgcaagggcgctggtgaacaaccctaaaatacttatttttgatgaagcaaccagtgctctggattatgagtcggagcatatcatcatgcgcaatatgcacaaaatatgtaagggcagaacggttataatcattgctcatcgtctgtctacagtaaaaaatgcagaccgcattattgtcatggaaaaagggaaaattgttgaacagggtaaacataaggaactgctttctgaaccggaaagtttatacagttacttatatcagttacagtcagactaacagaaagaacagaagaatatgaaaacatggttaatggggttcagcgagttcctgttgcgctataaacttgtctggagtgaaacatggaaaatccggaagcaattagatactccggtacgtgaaaaggacgaaaatgaattcttacccgctcatctggaattaattgaaacgccggtatccagacggccgcgtctggttgcttattttattatggggtttctggttattgctgtcattttatctgttttaggtcaggtggaaattgttgccactgcaaatgggaaattaacactaagtgggcgcagcaaagaaattaaacctattgaaaactcaatagttaaagaaattatcgtaaaagaaggagagtcagtccggaaaggggatgtgttattaaagcttacagcactgggagctgaagctgatacgttaaaaacacagtcatcactgttacagaccaggctggaacaaactcggtatcaaattctgagcaggtcaattgaattaaataaactacctgaactgaagcttcctgatgagccttattttcagaatgtatctgaagaggaagtactgcgtttaacttctttgataaaagaacagttttccacatggcaaaatcagaagtatcaaaaagaactgaatctggataagaaaagagcagagcgattaacaatacttgcccgtataaaccgttatgaaaatttatcgagagttgaaaaaagccgtctggatgatttcaggagtttattgcataaacaggcaattgcaaaacatgctgtacttgagcaggagaataaatatgtcgaggcagcaaatgaattacgggtttataaatcgcaactggagcaaattgagagtgagatattgtctgcaaaagaagaatatcagcttgtcacgcagctttttaaaaatgaaattttagacaagctaagacaaacaacagacaacattgagttattaactctggagttagagaaaaatgaagagcgtcaacaggcttcagtaatcagggcccctgtttcgggaaaagttcagcaactgaaggttcatactgaaggtggggttgttacaacagcggaaacactgatggtcatcgttccggaagatgacacgctggaggttactgctctggtacaaaataaagatattggttttattaacgtcgggcagaatgccatcattaaagtggaggcctttccttacacccgatatggttatctggtgggtaaggtgaaaaatataaatttagatgcaatagaagaccagaaactgggactcgtttttaatgtcattgtttctgttgaagagaatgatttgtcaaccgggaataagcacattccattaagctcgggtatggctgtcactgcagaaataaagactggaatgcgaagcgtaatcagctatcttcttagtcctctggaagagtctgtaacagaaagtttacatgagcgttaagtctcagagccgcggtatccggctcatatcttctcctg

SEQ ID NO: 801 - DNA, 104 bp, Artificial Sequence
  Synthetic: fliC promoter
agcgggaataaggggcagagaaaagagtatttcgtcgactaacaaaaaatggctgtttgtgaaaaaaattctaaaggttgttttacgacagacgataacagggt

SEQ ID NO: 802 - DNA, 45 bp, Artificial Sequence
  Synthetic: fliC 5 untranslated region
tgacggcgattgagccgacgggtggaaacccaaaacgtaatcaac

SEQ ID NO: 803 - DNA, 96 bp, Artificial Sequence
  Synthetic: Tetracycline responsive promoter
atctaatctagacatcattaattcctaatttttgttgacactctatcattgatagagttattttaccactccctatcagtgatagagaaaagtgaa

SEQ ID NO: 804 - DNA, 705 bp, Artificial Sequence
  Synthetic: Tetracycline responsive promoter
gaattcgttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcatttatagagttaatttaccactccctatcagtgatagagaa

SEQ ID NO: 805 - DNA, 25 bp, Artificial Sequence
  Synthetic: Optimized ribosome binding site
aaataaaaatgaggaggcaattcta

SEQ ID NO: 806 - DNA, 25 bp, Artificial Sequence
  Synthetic: Optimized ribosome binding site
agattataaggagttaaatagaaaa

SEQ ID NO: 807 - DNA, 35 bp, Artificial Sequence
  Synthetic: Optimized ribosome binding site
ctcaaagaattataggaaaggaggaagcgataagt

SEQ ID NO: 808 - DNA, 25 bp, Artificial Sequence
  Synthetic: Optimized ribosome binding site
atcaccaatttgaggaaaggtaaat

SEQ ID NO: 809 - DNA, 25 bp, Artificial Sequence
  Synthetic: Optimized ribosome binding site
tggcagacgcctaaggaggaagacc

SEQ ID NO: 810 - DNA, 25 bp, Artificial Sequence
  Synthetic: Optimized ribosome binding site
tacataattttggggagggtactcg

SEQ ID NO: 811 - DNA, 25 bp, Artificial Sequence
  Synthetic: Optimized ribosome binding site
ttaaatatcaactagaggtcaccaa

SEQ ID NO: 812 - DNA, 25 bp, Artificial Sequence
  Synthetic: Optimized ribosome binding site
tacgatttaattcggaggttttttg

SEQ ID NO: 813 - DNA, 25 bp, Artificial Sequence
  Synthetic: Optimized ribosome binding site
tcacaacgctgagagagagagaaat

SEQ ID NO: 814 - DNA, 25 bp, Artificial Sequence
  Synthetic: Optimized ribosome binding site
gttaaattgaggaggaggcagttcc

SEQ ID NO: 815 - DNA, 25 bp, Artificial Sequence
  Synthetic: Optimized ribosome binding site
tataccgaacgcttaaggaggcttt

SEQ ID NO: 816 - DNA, 25 bp, Artificial Sequence
  Synthetic: Optimized ribosome binding site
ataaatcccttcatgaggaggtaag

SEQ ID NO: 817 - DNA, 25 bp, Artificial Sequence
  Synthetic: Optimized ribosome binding site
gatagggaccaggtaaggaggatga

SEQ ID NO: 818 - DNA, 200 bp, Artificial Sequence
  Synthetic: Terminator sequence
tcgccgtaacctgattaactgagactgacggcaacgccaaattgcctgatgcgctgcgcttatcaggcctacaaggggaattgcaatttattgaatttgcacatttttgtaggccggataaggcgtttacgccgcatccggcaacatgaatggtaatttgccagcaacgtgcttccccgccaacggcggggttttttctg

SEQ ID NO: 819 - DNA, 96 bp, Artificial Sequence
  Synthetic: Terminator sequence
ctctaacggacttgagtgaggttgtaaagggagttggctcctcggtaccaaattccagaaaagaggcctcccgaaaggggggccttttttcgtttt

SEQ ID NO: 820 - DNA, 38 bp, Artificial Sequence
  Synthetic: Terminator sequence
gtctcagagccgcggtatccggctcatatcttctcctg

SEQ ID NO: 821 - DNA, 177 bp, Artificial Sequence
  Synthetic: N terminal secretion tag for Type V auto-secreter secretion
atgaacaaagtatatagcctgaaatattgcccagtaactgggggtctgattgtagtcagtgaactggcatcccgcgtcatcaaaaaaacctgccgtcgtctgactcacatcctgctggcgggtattccggctgtgtatctgtactacccgcagatctcccaggcaggtatcgtccgc

SEQ ID NO: 822 - DNA, 921 bp, Artificial Sequence
  Synthetic: C terminal secretion tag for Type V auto-secreter secretion
ttcaaagcggaggctgacaaggccgctgcagcaaaagctgactcctttatgaacgcgggttacaaaaacttcatgaccgaggtaaataatctcaataaacgtatgggtgatctgcgcgacactaatggggatgcaggcgcatgggcacgcattatgtctggtgcaggttcggcggatggcgggtattctgacaattacactcatgttcaggtgggcttcgataaaaaacatgagctggacggtgtggatctgttcactggcgtaaccatgacttatactgattcaagcgcagacagccacgcattttcaggtaaaacgaaatcagttggcggcggtctgtatgcgagcgcactgttcgagagcggcgcctacattgatctaattggcaagtatattcaccatgataatgattacacagggaactttgcaggcctgggcaccaaacactataacacgcattcatggtacgctggcgcagaaaccggctatagataccacctgaccgaggaaacctttatcgaaccgcaagcggaactggtttacggtgcggtcagtggcaagacctttcgttggaaagatggtgatatggatctgtcaatgaaaaaccgcgacttcagccccttgatcggccgcaccggcattgagctgggcaaaaccttctctggcaaagattggtctgttaccgcgcgtgcgggcacttcgtggcaatttgatctgctaaacaacggtgagactgtactgcgtgatgcgagtggcgaaaaacgtattaaaggtgaaaaagatagtagaatgctattcaacgtgggcatgaatgcgcagatcaaagataacatgcgttttgggttggagtttgaaaaatccgcgttcggtaaatataatgttgacaatgctgtgaacgcgaatttccgctacatgttttaa

SEQ ID NO: 823 - DNA, 729 bp, Artificial Sequence
  Synthetic: Anti-CTLA-4 single chain antibody coding region (Heavy Chain  linker  Light Chain)
atgcaagtgcaactggtagagtccggtgggggcgtggtgcagccgggtcgcagcctgcgtctgtcgtgcgcggcgagtggttttacgttttcgagttatactatgcactgggttcgtcaagcgccgggcaaaggcctggaatgggttactttcatttcttacgatggtaataataaatattatgcggattctgtgaaaggtcgctttactatttcgcgcgataacagtaaaaacactctgtatctgcaaatgaattctctgcgtgcagaggatactgctatctattactgcgcgcgtacgggctggttgggcccgtttgattattggggccaaggcactttggttactgtgtcatcgggcgggggctctggcggtggttcaggtggtggcagtggtggtggcgagatcgtgttgactcaatctccgggtactctgtctctgtctccgggtgaacgcgcgaccctgtcttgccgcgcttctcagagtgttggttcatcgtatctggcatggtatcaacagaaaccgggtcaagcgccgcgtctgctgatttacggtgcttttagtcgcgcaaccgggattccggatcgattttctggttcaggttctggcactgactttactttgactattagtcgtctggaaccggaggacttcgcggtttattattgccaacagtatggttcttctccgtggacctttggtcaaggcactaaagttgaaattaaataa

SEQ ID NO: 824 - DNA, 729 bp, Artificial Sequence
  Synthetic: Anti-CTLA-4 single chain antibody coding region (Light Chain  linker  Heavy Chain)
atggagattgtactgacccagagccctggtacattgtctttgtcgcctggtgaacgcgcgactctgtcttgtcgtgcgtctcagtctgttggtagttcgtatctggcgtggtatcaacaaaaaccgggccaagctccgcgtctgctgatttacggtgcatttagccgcgcgactggcattccggaccgcttttctgggtctggctcaggtaccgattttactctgactatttcgcgtctggagccggaggatttcgcggtttattactgccagcaatatggttctagtccgtggaccttcggccaaggtactaaagtggaaatcaaaggcgggggttcgggtggtggctctgggggtggctcgggcggtgggcaggtgcaactggttgagagtggtggcggcgttgttcaaccgggccgctctctgcgcctgtcgtgcgctgcttctggctttacctttagctcttatacgatgcactgggttcgccaagctccgggtaaaggtctggagtgggtgactttcatttcttacgatggtaacaacaaatattatgctgattctgttaaaggccgttttactatttctcgagacaatagcaaaaacactctgtacctgcagatgaattctctgcgcgctgaagacaccgcgatttattattgtgcgcgcactggttggctgggtccgtttgattattggggtcagggcacgctggttactgttagctcgtga

SEQ ID NO: 825 - DNA, 711 bp, Artificial Sequence
  Synthetic: Anti-PD-1 single chain antibody coding region (Heavy Chain  linker  Light Chain)
atgcaggtgcaattggtggagtcgggtggcggcgtggtgcaaccgggtcgtagcctgcgcctggattgtaaagcgtcaggcatcacgtttagcaattctggcatgcactgggtgcgtcaagcgccgggcaaaggtctggagtgggttgcggtaatttggtacgatggttctaaacgctattacgcggatagtgtgaaaggtcgctttactatctctcgcgataattctaaaaacaccctgtttctgcaaatgaattcgttgcgtgcggaagatactgcggtatattattgtgctactaacgatgattattggggtcaaggcaccctggtgactgtttcgagcggcggtggtagcggcggcggctctggtggtggttctggtggcggtgagattgtgctgactcaaagcccggcgaccctgtctctgtcgccgggtgaacgcgctactctgagttgccgtgcgtcgcaaagcgtgtcttcttatctggcgtggtaccaacaaaaaccgggtcaagcgccgcgcctgctgatatatgatgctagtaatcgtgcaacgggtattccggcacgcttttcaggttctggcagcggcaccgatttcactctgactatctcgtcactggagccggaagactttgcggtttattattgtcagcaatcttctaattggccgcgtacgtttggtcagggcactaaagttgaaatcaaataa

SEQ ID NO: 826 - DNA, 711 bp, Artificial Sequence
  Synthetic: Anti-PD-1 single chain antibody coding region (Light Chain  linker  Heavy Chain)
atggaaatcgttttaacgcagtcgccggcgactctgtctttgtcgcctggtgaacgtgctacgctgtcttgccgcgcgtcacagtctgtgtcgtcatatctggcttggtaccaacagaaaccgggccaagctccgcgcctgctgatttatgatgcgtctaatcgcgcgaccggcattccggcgcgtttttctggctccggctctggcaccgactttactctgactatttcgtctctggaaccggaagattttgcggtgtactattgccagcaatcttctaattggccgcgcacgtttggtcaaggtaccaaggttgagatcaaaggtggtggctcgggcggcggttcgggcggcggctcaggtggtggccaagttcagttggttgagtctggcgggggcgtagtacaaccgggtcgttctttgcgtctggattgcaaagcgagcggtattacctttagcaattcaggtatgcactgggtgcgccaagcgccgggcaaaggcctggaatgggttgcggtgatttggtacgatggctcgaaacgttattatgctgacagcgttaaaggtcgttttactattagccgtgataattccaaaaatacgctgtttctgcagatgaatagcctgcgtgctgaagacactgcggtttattactgtgctactaatgatgattactggggccagggcaccctggtgactgtgagttcttaa

SEQ ID NO: 827 - DNA, 729 bp, Artificial Sequence
  Synthetic: Anti-PD-L1 single chain antibody coding region (Light Chain  linker  Heavy Chain)
atggatattcagatgactcagagccctagctcactgtctgcgtcagttggcgatcgtgtgactattacctgtcgcgctagtcaggatgtgtctacggcggttgcgtggtatcaacagaaaccgggcaaagctccgaaactgttgatttattcagcgtctttcctgtattcgggtgtgccttctcgcttttcgggctctggtagcggtactgattttacgctgactattagttcactgcaaccggaggactttgcgacttattattgccaacaatacctgtatcacccggcgacctttggtcaaggcactaaagtggaaattaaacgcggcggcggcagcggtggcggctctggtggtgggtctggtggtggtgaggttcagctggttgagtctggtggtggtctggttcaacctgggggcagcctgcgcctgtcgtgcgcggcgtctggttttacgttctcagattcttggattcactgggtacgtcaagctccgggcaaaggtctggagtgggtggcgtggatttctccgtatggcggttcgacgtattacgcggactctgttaaagggcgttttacgatctcagcggatacttctaaaaatactgcgtatctgcaaatgaattctctgcgagcggaggataccgcggtgtattactgtgctcgccgccactggcctggtggtttcgattattggggtcaaggtaccctggtgactgtttcgtcttaa

SEQ ID NO: 828 - DNA, 729 bp, Artificial Sequence
  Synthetic: Anti-PD-L1 single chain antibody coding region (Heavy Chain  linker  Light Chain)
atggaagttcagctggtggagagtggtggcggtctggtgcagccgggcggctctctgcgtctgagctgtgcggcgtctggctttacgttttctgacagttggattcactgggtgcgccaagcaccgggcaaaggcctggagtgggtggcgtggatttctccgtatggcggtagtacttattatgctgattctgtgaaaggccgttttaccatttcggcggacacttcaaaaaataccgcgtatctgcaaatgaatagcctgcgcgctgaagacacggctgtttactactgtgctcgccgccactggccgggcggtttcgattattggggccaaggcactctggtgactgtgagctctggcggcgggtcgggtggcggttctggcggtggcagtggcggtggtgatattcaaatgacccaatctccgtcgtctctgagcgcgtctgtgggcgatcgtgtaaccattacttgtcgtgcgtcgcaggatgtgtctactgctgtggcgtggtatcagcaaaaaccgggtaaagctccgaaactgctgatttatagcgcttcttttctgtatagtggtgttccgtcacgttttagcggttcaggctctggtactgatttcacactgactatttcttctctgcaaccggaagatttcgcgacttattattgtcagcagtacttgtaccacccggcaacttttggtcagggcactaaagttgaaattaaacgttaa

SEQ ID NO: 829 - DNA, 1821 bp, Artificial Sequence
  Synthetic: Anti-CTLA-4 single chain antibody coding region (Heavy Chain  linker  Light Chain) with N terminal and C terminal Secretion Tag for Type V auto-secreter
atgaacaaagtatatagcctgaaatattgcccagtaactgggggtctgattgtagtcagtgaactggcatcccgcgtcatcaaaaaaacctgccgtcgtctgactcacatcctgctggcgggtattccggctgtgtatctgtactacccgcagatctcccaggcaggtatcgtccgccaggtacaattagttgagagcggcggcggtgtggttcaaccgggccgtagtctgcgattgtcttgtgctgcatctggttttactttcagttcttacacgatgcactgggttcgccaagctccgggcaaaggcctggagtgggttacctttatttcttacgatggcaataataagtattacgctgattctgtgaaaggtcgctttactattagccgagataactctaaaaatactctgtatctgcaaatgaattctctgcgtgcggaagatactgcgatctattattgtgcgcgtactggttggctgggcccgtttgattattggggccaaggcacgctggttactgttagttcgggcggcggttctggtggcggctctggtggtggctctggcggcggcgagattgtgctgactcaatctccgggcacgctgtcactgtctccgggtgaacgcgcgaccctgtcttgtcgcgcgagtcaaagtgttggttcttcttatctggcttggtatcagcaaaagcctggtcaagcgccgcgtctgttgatttatggcgcgttttcgcgcgcgactggcattccggaccgattttctggttctggttctggcactgatttcactctgaccatttcacgcctggaaccggaggattttgcggtgtactattgccaacaatatggctcatcgccgtggacgtttggccaaggtactaaagttgagattaaattcaaagcggaggctgacaaggccgctgcagcaaaagctgactcctttatgaacgcgggttacaaaaacttcatgaccgaggtaaataatctcaataaacgtatgggtgatctgcgcgacactaatggggatgcaggcgcatgggcacgcattatgtctggtgcaggttcggcggatggcgggtattctgacaattacactcatgttcaggtgggcttcgataaaaaacatgagctggacggtgtggatctgttcactggcgtaaccatgacttatactgattcaagcgcagacagccacgcattttcaggtaaaacgaaatcagttggcggcggtctgtatgcgagcgcactgttcgagagcggcgcctacattgatctaattggcaagtatattcaccatgataatgattacacagggaactttgcaggcctgggcaccaaacactataacacgcattcatggtacgctggcgcagaaaccggctatagataccacctgaccgaggaaacctttatcgaaccgcaagcggaactggtttacggtgcggtcagtggcaagacctttcgttggaaagatggtgatatggatctgtcaatgaaaaaccgcgacttcagccccttgatcggccgcaccggcattgagctgggcaaaaccttctctggcaaagattggtctgttaccgcgcgtgcgggcacttcgtggcaatttgatctgctaaacaacggtgagactgtactgcgtgatgcgagtggcgaaaaacgtattaaaggtgaaaaagatagtagaatgctattcaacgtgggcatgaatgcgcagatcaaagataacatgcgttttgggttggagtttgaaaaatccgcgttcggtaaatataatgttgacaatgctgtgaacgcgaatttccgctacatgttttaa

SEQ ID NO: 830 - DNA, 1821 bp, Artificial Sequence
  Synthetic: Anti-CTLA-4 single chain antibody coding region (Light Chain  linker  Heavy Chain) with N terminal and C terminal Secretion Tag for Type V auto-secreter
atgaacaaagtatatagcctgaaatattgcccagtaactgggggtctgattgtagtcagtgaactggcatcccgcgtcatcaaaaaaacctgccgtcgtctgactcacatcctgctggcgggtattccggctgtgtatctgtactacccgcagatctcccaggcaggtatcgtccgcgaaattgtactgacccagtcgcctggtaccctgtctctgtcgccgggtgaacgtgctaccctgtcttgtcgtgcttcgcaatcggttggctcgtcttatctggcatggtatcagcaaaaaccgggccaagcgcctcgtctgctgatttatggcgcgttttctcgtgctacgggcattcctgatcgtttttcgggctctggctctggtactgattttacgctgactatcagccgcttggaacctgaagattttgcggtttattattgccaacaatatggctcttctccgtggacgtttggtcaaggcactaaagttgaaattaaaggtggtggctcgggcggtggttctggtggtggtagtggtggtggtcaagtgcagttggttgaatcgggtggcggtgttgtgcagccgggccgttcgttgcgtctgtcttgcgcagcgagtggtttcaccttctcttcttatactatgcactgggtgcgtcaagcacctggcaaaggtctggagtgggtaacttttatttcatacgatggtaataataaatattatgcagattctgttaaaggtcgctttacgatttctcgcgataattcaaaaaatacgctgtatctgcagatgaattcgctgcgcgctgaggatactgcgatctactattgtgcgcgtactggttggctgggtccgtttgattactggggccaaggtacgctggttacagtttcgtcgttcaaagcggaggctgacaaggccgctgcagcaaaagctgactcctttatgaacgcgggttacaaaaacttcatgaccgaggtaaataatctcaataaacgtatgggtgatctgcgcgacactaatggggatgcaggcgcatgggcacgcattatgtctggtgcaggttcggcggatggcgggtattctgacaattacactcatgttcaggtgggcttcgataaaaaacatgagctggacggtgtggatctgttcactggcgtaaccatgacttatactgattcaagcgcagacagccacgcattttcaggtaaaacgaaatcagttggcggcggtctgtatgcgagcgcactgttcgagagcggcgcctacattgatctaattggcaagtatattcaccatgataatgattacacagggaactttgcaggcctgggcaccaaacactataacacgcattcatggtacgctggcgcagaaaccggctatagataccacctgaccgaggaaacctttatcgaaccgcaagcggaactggtttacggtgcggtcagtggcaagacctttcgttggaaagatggtgatatggatctgtcaatgaaaaaccgcgacttcagccccttgatcggccgcaccggcattgagctgggcaaaaccttctctggcaaagattggtctgttaccgcgcgtgcgggcacttcgtggcaatttgatctgctaaacaacggtgagactgtactgcgtgatgcgagtggcgaaaaacgtattaaaggtgaaaaagatagtagaatgctattcaacgtgggcatgaatgcgcagatcaaagataacatgcgttttgggttggagtttgaaaaatccgcgttcggtaaatataatgttgacaatgctgtgaacgcgaatttccgctacatgttttaa

SEQ ID NO: 831 - DNA, 1803 bp, Artificial Sequence
  Synthetic: Anti-PD-1 single chain antibody coding region (Heavy Chain  linker  Light Chain) with N terminal and C terminal Secretion Tag for Type V auto-secreter
atgaacaaagtatatagcctgaaatattgcccagtaactgggggtctgattgtagtcagtgaactggcatcccgcgtcatcaaaaaaacctgccgtcgtctgactcacatcctgctggcgggtattccggctgtgtatctgtactacccgcagatctcccaggcaggtatcgtccgccaagtacaactggttgaatccggcggaggagtggtgcaaccgggccgcagtttgcgtctggattgtaaagcttcaggcatcactttttctaattctggtatgcactgggttcgccaagctccgggtaaaggtctggagtgggttgcggtgatctggtatgatggttctaaacgatattatgcggatagtgttaagggtcgttttactatttctcgtgataattctaagaacaccttgtttctgcagatgaatagtctgcgcgctgaggatactgcggtatattattgtgcgactaatgacgattattggggccaaggcacgctggttaccgtgagctctggtggtggttcgggtggtggttctggtggtgggagcggcggtggcgagatcgttctgactcaaagcccggcgactctgagtctgagtccgggtgaacgtgcgactctgagctgccgtgcgtctcagagtgtgtcgagttatctggcgtggtaccaacaaaaaccgggccaggcgccgcgactgctgatttatgatgcttctaatcgtgcgactggtattccggcgcgctttagcggttctggctcaggcactgacttcactctgactatttcttcgctggaaccggaagattttgcggtgtactattgtcaacaatcatctaattggcctcgtacgttcggtcaaggtacaaaagtggagataaaattcaaagcggaggctgacaaggccgctgcagcaaaagctgactcctttatgaacgcgggttacaaaaacttcatgaccgaggtaaataatctcaataaacgtatgggtgatctgcgcgacactaatggggatgcaggcgcatgggcacgcattatgtctggtgcaggttcggcggatggcgggtattctgacaattacactcatgttcaggtgggcttcgataaaaaacatgagctggacggtgtggatctgttcactggcgtaaccatgacttatactgattcaagcgcagacagccacgcattttcaggtaaaacgaaatcagttggcggcggtctgtatgcgagcgcactgttcgagagcggcgcctacattgatctaattggcaagtatattcaccatgataatgattacacagggaactttgcaggcctgggcaccaaacactataacacgcattcatggtacgctggcgcagaaaccggctatagataccacctgaccgaggaaacctttatcgaaccgcaagcggaactggtttacggtgcggtcagtggcaagacctttcgttggaaagatggtgatatggatctgtcaatgaaaaaccgcgacttcagccccttgatcggccgcaccggcattgagctgggcaaaaccttctctggcaaagattggtctgttaccgcgcgtgcgggcacttcgtggcaatttgatctgctaaacaacggtgagactgtactgcgtgatgcgagtggcgaaaaacgtattaaaggtgaaaaagatagtagaatgctattcaacgtgggcatgaatgcgcagatcaaagataacatgcgttttgggttggagtttgaaaaatccgcgttcggtaaatataatgttgacaatgctgtgaacgcgaatttccgctacatgttttaa

SEQ ID NO: 832 - DNA, 1803 bp, Artificial Sequence
  Synthetic: Anti-PD-1 single chain antibody coding region (Light Chain  linker  Heavy Chain) with N terminal and C terminal Secretion Tag for Type V auto-secreter
atgaacaaagtatatagcctgaaatattgcccagtaactgggggtctgattgtagtcagtgaactggcatcccgcgtcatcaaaaaaacctgccgtcgtctgactcacatcctgctggcgggtattccggctgtgtatctgtactacccgcagatctcccaggcaggtatcgtccgcgaaatcgtgctgactcagagtccggcgactctgtctctgagtccgggcgaacgcgcgactctgtcttgccgtgcgtctcaatctgtgtcttcatacttggcttggtaccaacaaaaaccgggccaggcgccgcgactgttgatttatgatgcgtcgaatcgcgcgactggcattccggcgcgcttttcgggtagcggttctggtactgattttacgctgactatctcttctctggagcctgaagatttcgctgtttattactgccaacagtctagtaattggccgcgtactttcggccagggcactaaggtggaaattaaaggtggcggctcgggcggcggctcgggtggtggttctggtggtggccaagtgcaactggtggaaagtggcggcggggtggtgcaaccgggccgttctctgcgcctggattgtaaagcttcaggcattacttttagcaactctggtatgcactgggttcgccaagctccgggcaaaggcctggaatgggtggcggttatttggtacgatggctctaaacgttattacgctgacagtgttaaaggccgctttaccatttctcgtgataattctaaaaataccctgtttctgcaaatgaactcgctgcgcgcggaagatactgctgtttactattgtgcgactaatgatgattactggggtcaaggtaccctggttaccgtgtcttctttcaaagcggaggctgacaaggccgctgcagcaaaagctgactcctttatgaacgcgggttacaaaaacttcatgaccgaggtaaataatctcaataaacgtatgggtgatctgcgcgacactaatggggatgcaggcgcatgggcacgcattatgtctggtgcaggttcggcggatggcgggtattctgacaattacactcatgttcaggtgggcttcgataaaaaacatgagctggacggtgtggatctgttcactggcgtaaccatgacttatactgattcaagcgcagacagccacgcattttcaggtaaaacgaaatcagttggcggcggtctgtatgcgagcgcactgttcgagagcggcgcctacattgatctaattggcaagtatattcaccatgataatgattacacagggaactttgcaggcctgggcaccaaacactataacacgcattcatggtacgctggcgcagaaaccggctatagataccacctgaccgaggaaacctttatcgaaccgcaagcggaactggtttacggtgcggtcagtggcaagacctttcgttggaaagatggtgatatggatctgtcaatgaaaaaccgcgacttcagccccttgatcggccgcaccggcattgagctgggcaaaaccttctctggcaaagattggtctgttaccgcgcgtgcgggcacttcgtggcaatttgatctgctaaacaacggtgagactgtactgcgtgatgcgagtggcgaaaaacgtattaaaggtgaaaaagatagtagaatgctattcaacgtgggcatgaatgcgcagatcaaagataacatgcgttttgggttggagtttgaaaaatccgcgttcggtaaatataatgttgacaatgctgtgaacgcgaatttccgctacatgttttaa

SEQ ID NO: 833 - DNA, 1821 bp, Artificial Sequence
  Synthetic: Anti-PD-L1 single chain antibody coding region (Light Chain  linker  Heavy Chain) with N terminal and C terminal Secretion Tag for Type V auto-secreter
atgaacaaagtatatagcctgaaatattgcccagtaactgggggtctgattgtagtcagtgaactggcatcccgcgtcatcaaaaaaacctgccgtcgtctgactcacatcctgctggcgggtattccggctgtgtatctgtactacccgcagatctcccaggcaggtatcgtccgcgatattcaaatgactcaatctccgagctctctgagtgcgtctgtgggtgatcgtgtgactattacttgtcgtgcgtctcaagatgtttcaactgcggttgcgtggtatcaacagaaaccgggcaaggcgcctaagctgctgatttattctgcttcgttcctgtacagcggtgtgccgtctcgtttctctggctctggttcgggtactgatttcactctgactatttcgagtctgcagccggaagattttgcgacttattattgtcaacaatatctgtatcaccctgcgacgtttggtcaaggcacgaaagttgaaattaaacgtggtggtggctctggtggtggcagcggtggtgggtcgggtggcggtgaagttcaactggttgagtcaggtggtggcctggtgcaaccgggcggctctctgcgcctgtcttgtgctgcgtcgggttttacgttctctgatagctggattcactgggtacgccaggcaccgggcaaaggtctggaatgggtagcttggatttcaccttatggtggctctacttattacgcggatagcgtgaaaggtcgctttactatttctgcggacactagcaaaaatactgcttacctgcaaatgaattcgctgcgtgctgaggatactgcagtgtattactgtgcgcgtcgtcattggcctggcggctttgattattggggtcaaggtactctggttactgttagcagcttcaaagcggaggctgacaaggccgctgcagcaaaagctgactcctttatgaacgcgggttacaaaaacttcatgaccgaggtaaataatctcaataaacgtatgggtgatctgcgcgacactaatggggatgcaggcgcatgggcacgcattatgtctggtgcaggttcggcggatggcgggtattctgacaattacactcatgttcaggtgggcttcgataaaaaacatgagctggacggtgtggatctgttcactggcgtaaccatgacttatactgattcaagcgcagacagccacgcattttcaggtaaaacgaaatcagttggcggcggtctgtatgcgagcgcactgttcgagagcggcgcctacattgatctaattggcaagtatattcaccatgataatgattacacagggaactttgcaggcctgggcaccaaacactataacacgcattcatggtacgctggcgcagaaaccggctatagataccacctgaccgaggaaacctttatcgaaccgcaagcggaactggtttacggtgcggtcagtggcaagacctttcgttggaaagatggtgatatggatctgtcaatgaaaaaccgcgacttcagccccttgatcggccgcaccggcattgagctgggcaaaaccttctctggcaaagattggtctgttaccgcgcgtgcgggcacttcgtggcaatttgatctgctaaacaacggtgagactgtactgcgtgatgcgagtggcgaaaaacgtattaaaggtgaaaaagatagtagaatgctattcaacgtgggcatgaatgcgcagatcaaagataacatgcgttttgggttggagtttgaaaaatccgcgttcggtaaatataatgttgacaatgctgtgaacgcgaatttccgctacatgttttaa

SEQ ID NO: 834 - DNA, 1821 bp, Artificial Sequence
  Synthetic: Anti-PD-L1 single chain antibody coding region (Heavy Chain  linker  Light Chain) with N terminal and C terminal Secretion Tag for Type V auto-secreter
atgaacaaagtatatagcctgaaatattgcccagtaactgggggtctgattgtagtcagtgaactggcatcccgcgtcatcaaaaaaacctgccgtcgtctgactcacatcctgctggcgggtattccggctgtgtatctgtactacccgcagatctcccaggcaggtatcgtccgcgaagtgcagctggtggagtcaggtggaggcttggtgcaaccgggcggttcactgcgtctgtcatgtgcggcgtctgggtttacttttagtgactcttggattcactgggtgcgccaggctccgggtaaaggcctggaatgggtagcttggattagtccttacggtggctcgacctattatgctgattcggtaaagggtcgctttactattagcgctgatacttctaaaaatactgcatacctgcagatgaatagcctgcgcgctgaggatactgctgtgtattattgcgcgcgtcgccactggccgggcggctttgattattggggccaaggtactctggttaccgtgtctagtggcggtggtagcggcggcggctcaggtggcggctcgggcggtggcgacattcagatgactcagtctccgtcttctttgtcggcgagcgtgggcgatcgtgttaccatcacgtgtcgcgcgagccaagatgtgtcgactgcggtggcttggtatcaacaaaaaccgggtaaagctccgaaactgctgatttatagtgcgtcttttttgtattctggtgttccgtctcgtttctctggctcaggtagcggtactgattttacgctgactatttcttcactgcaaccggaagattttgctacgtattattgtcaacaatatctgtatcacccggcgacgtttggtcagggtactaaggtggagataaaacgcttcaaagcggaggctgacaaggccgctgcagcaaaagctgactcctttatgaacgcgggttacaaaaacttcatgaccgaggtaaataatctcaataaacgtatgggtgatctgcgcgacactaatggggatgcaggcgcatgggcacgcattatgtctggtgcaggttcggcggatggcgggtattctgacaattacactcatgttcaggtgggcttcgataaaaaacatgagctggacggtgtggatctgttcactggcgtaaccatgacttatactgattcaagcgcagacagccacgcattttcaggtaaaacgaaatcagttggcggcggtctgtatgcgagcgcactgttcgagagcggcgcctacattgatctaattggcaagtatattcaccatgataatgattacacagggaactttgcaggcctgggcaccaaacactataacacgcattcatggtacgctggcgcagaaaccggctatagataccacctgaccgaggaaacctttatcgaaccgcaagcggaactggtttacggtgcggtcagtggcaagacctttcgttggaaagatggtgatatggatctgtcaatgaaaaaccgcgacttcagccccttgatcggccgcaccggcattgagctgggcaaaaccttctctggcaaagattggtctgttaccgcgcgtgcgggcacttcgtggcaatttgatctgctaaacaacggtgagactgtactgcgtgatgcgagtggcgaaaaacgtattaaaggtgaaaaagatagtagaatgctattcaacgtgggcatgaatgcgcagatcaaagataacatgcgttttgggttggagtttgaaaaatccgcgttcggtaaatataatgttgacaatgctgtgaacgcgaatttccgctacatgttttaa

SEQ ID NO: 835 - DNA, 885 bp, Artificial Sequence
  Synthetic: Anti-CTLA-4 single chain antibody coding region (Heavy Chain  linker  Light Chain) for type I hemolysin secretion, including HlyA tag
atgcaggtacaattagttgagagcggcggcggtgtggttcaaccgggccgtagtctgcgattgtcttgtgctgcatctggttttactttcagttcttacacgatgcactgggttcgccaagctccgggcaaaggcctggagtgggttacctttatttcttacgatggcaataataagtattacgctgattctgtgaaaggtcgctttactattagccgagataactctaaaaatactctgtatctgcaaatgaattctctgcgtgcggaagatactgcgatctattattgtgcgcgtactggttggctgggcccgtttgattattggggccaaggcacgctggttactgttagttcgggcggcggttctggtggcggctctggtggtggctctggcggcggcgagattgtgctgactcaatctccgggcacgctgtcactgtctccgggtgaacgcgcgaccctgtcttgtcgcgcgagtcaaagtgttggttcttcttatctggcttggtatcagcaaaagcctggtcaagcgccgcgtctgttgatttatggcgcgttttcgcgcgcgactggcattccggaccgattttctggttctggttctggcactgatttcactctgaccatttcacgcctggaaccggaggattttgcggtgtactattgccaacaatatggctcatcgccgtggacgtttggccaaggtactaaagttgagattaaacttaatccattaattaatgaaatcagcaaaatcatttcagctgcaggtaattttgatgttaaagaggaaagagctgcagcttctttattgcagttgtccggtaatgccagtgatttttcatatggacggaactcaataactttgacagcatcagcataa

SEQ ID NO: 836 - DNA, 885 bp, Artificial Sequence
  Synthetic: Anti-CTLA-4 single chain antibody coding region (Light Chain  linker  Heavy Chain) for type I hemolysin secretion, including HlyA tag
atggaaattgtactgacccagtcgcctggtaccctgtctctgtcgccgggtgaacgtgctaccctgtcttgtcgtgcttcgcaatcggttggctcgtcttatctggcatggtatcagcaaaaaccgggccaagcgcctcgtctgctgatttatggcgcgttttctcgtgctacgggcattcctgatcgtttttcgggctctggctctggtactgattttacgctgactatcagccgcttggaacctgaagattttgcggtttattattgccaacaatatggctcttctccgtggacgtttggtcaaggcactaaagttgaaattaaaggtggtggctcgggcggtggttctggtggtggtagtggtggtggtcaagtgcagttggttgaatcgggtggcggtgttgtgcagccgggccgttcgttgcgtctgtcttgcgcagcgagtggtttcaccttctcttcttatactatgcactgggtgcgtcaagcacctggcaaaggtctggagtgggtaacttttatttcatacgatggtaataataaatattatgcagattctgttaaaggtcgctttacgatttctcgcgataattcaaaaaatacgctgtatctgcagatgaattcgctgcgcgctgaggatactgcgatctactattgtgcgcgtactggttggctgggtccgtttgattactggggccaaggtacgctggttacagtttcgtcgcttaatccattaattaatgaaatcagcaaaatcatttcagctgcaggtaattttgatgttaaagaggaaagagctgcagcttctttattgcagttgtccggtaatgccagtgatttttcatatggacggaactcaataactttgacagcatcagcataa

SEQ ID NO: 837 - DNA, 867 bp, Artificial Sequence
  Synthetic: Anti-PD-1 single chain antibody coding region (Heavy Chain  linker  Light Chain) for type I hemolysin secretion, including HlyA tag
atgcaagtacaactggttgaatccggcggaggagtggtgcaaccgggccgcagtttgcgtctggattgtaaagcttcaggcatcactttttctaattctggtatgcactgggttcgccaagctccgggtaaaggtctggagtgggttgcggtgatctggtatgatggttctaaacgatattatgcggatagtgttaagggtcgttttactatttctcgtgataattctaagaacaccttgtttctgcagatgaatagtctgcgcgctgaggatactgcggtatattattgtgcgactaatgacgattattggggccaaggcacgctggttaccgtgagctctggtggtggttcgggtggtggttctggtggtgggagcggcggtggcgagatcgttctgactcaaagcccggcgactctgagtctgagtccgggtgaacgtgcgactctgagctgccgtgcgtctcagagtgtgtcgagttatctggcgtggtaccaacaaaaaccgggccaggcgccgcgactgctgatttatgatgcttctaatcgtgcgactggtattccggcgcgctttagcggttctggctcaggcactgacttcactctgactatttcttcgctggaaccggaagattttgcggtgtactattgtcaacaatcatctaattggcctcgtacgttcggtcaaggtacaaaagtggagataaaacttaatccattaattaatgaaatcagcaaaatcatttcagctgcaggtaattttgatgttaaagaggaaagagctgcagcttctttattgcagttgtccggtaatgccagtgatttttcatatggacggaactcaataactttgacagcatcagcataa

SEQ ID NO: 838 - DNA, 867 bp, Artificial Sequence
  Synthetic: Anti-PD-1 single chain antibody coding region (Light Chain  linker  Heavy Chain) for type I hemolysin secretion, including HlyA tag
atggaaatcgtgctgactcagagtccggcgactctgtctctgagtccgggcgaacgcgcgactctgtcttgccgtgcgtctcaatctgtgtcttcatacttggcttggtaccaacaaaaaccgggccaggcgccgcgactgttgatttatgatgcgtcgaatcgcgcgactggcattccggcgcgcttttcgggtagcggttctggtactgattttacgctgactatctcttctctggagcctgaagatttcgctgtttattactgccaacagtctagtaattggccgcgtactttcggccagggcactaaggtggaaattaaaggtggcggctcgggcggcggctcgggtggtggttctggtggtggccaagtgcaactggtggaaagtggcggcggggtggtgcaaccgggccgttctctgcgcctggattgtaaagcttcaggcattacttttagcaactctggtatgcactgggttcgccaagctccgggcaaaggcctggaatgggtggcggttatttggtacgatggctctaaacgttattacgctgacagtgttaaaggccgctttaccatttctcgtgataattctaaaaataccctgtttctgcaaatgaactcgctgcgcgcggaagatactgctgtttactattgtgcgactaatgatgattactggggtcaaggtaccctggttaccgtgtcttctcttaatccattaattaatgaaatcagcaaaatcatttcagctgcaggtaattttgatgttaaagaggaaagagctgcagcttctttattgcagttgtccggtaatgccagtgatttttcatatggacggaactcaataactttgacagcatcagcataa

SEQ ID NO: 839 - DNA, 885 bp, Artificial Sequence
  Synthetic: Anti-PD-L1 single chain antibody coding region (Light Chain  linker  Heavy Chain) for type I hemolysin secretion, including HlyA tag
atggatattcaaatgactcaatctccgagctctctgagtgcgtctgtgggtgatcgtgtgactattacttgtcgtgcgtctcaagatgtttcaactgcggttgcgtggtatcaacagaaaccgggcaaggcgcctaagctgctgatttattctgcttcgttcctgtacagcggtgtgccgtctcgtttctctggctctggttcgggtactgatttcactctgactatttcgagtctgcagccggaagattttgcgacttattattgtcaacaatatctgtatcaccctgcgacgtttggtcaaggcacgaaagttgaaattaaacgtggtggtggctctggtggtggcagcggtggtgggtcgggtggcggtgaagttcaactggttgagtcaggtggtggcctggtgcaaccgggcggctctctgcgcctgtcttgtgctgcgtcgggttttacgttctctgatagctggattcactgggtacgccaggcaccgggcaaaggtctggaatgggtagcttggatttcaccttatggtggctctacttattacgcggatagcgtgaaaggtcgctttactatttctgcggacactagcaaaaatactgcttacctgcaaatgaattcgctgcgtgctgaggatactgcagtgtattactgtgcgcgtcgtcattggcctggcggctttgattattggggtcaaggtactctggttactgttagcagccttaatccattaattaatgaaatcagcaaaatcatttcagctgcaggtaattttgatgttaaagaggaaagagctgcagcttctttattgcagttgtccggtaatgccagtgatttttcatatggacggaactcaataactttgacagcatcagcataa

SEQ ID NO: 840 - DNA, 885 bp, Artificial Sequence
  Synthetic: Anti-PD-L1 single chain antibody coding region (Heavy Chain  linker  Light Chain) for type I hemolysin secretion, including HlyA tag
atggaagtgcagctggtggagtcaggtggaggcttggtgcaaccgggcggttcactgcgtctgtcatgtgcggcgtctgggtttacttttagtgactcttggattcactgggtgcgccaggctccgggtaaaggcctggaatgggtagcttggattagtccttacggtggctcgacctattatgctgattcggtaaagggtcgctttactattagcgctgatacttctaaaaatactgcatacctgcagatgaatagcctgcgcgctgaggatactgctgtgtattattgcgcgcgtcgccactggccgggcggctttgattattggggccaaggtactctggttaccgtgtctagtggcggtggtagcggcggcggctcaggtggcggctcgggcggtggcgacattcagatgactcagtctccgtcttctttgtcggcgagcgtgggcgatcgtgttaccatcacgtgtcgcgcgagccaagatgtgtcgactgcggtggcttggtatcaacaaaaaccgggtaaagctccgaaactgctgatttatagtgcgtcttttttgtattctggtgttccgtctcgtttctctggctcaggtagcggtactgattttacgctgactatttcttcactgcaaccggaagattttgctacgtattattgtcaacaatatctgtatcacccggcgacgtttggtcagggtactaaggtggagataaaacgccttaatccattaattaatgaaatcagcaaaatcatttcagctgcaggtaattttgatgttaaagaggaaagagctgcagcttctttattgcagttgtccggtaatgccagtgatttttcatatggacggaactcaataactttgacagcatcagcataa

SEQ ID NO: 841 - DNA, 159 bp, Artificial Sequence; identical to SEQ ID NO: 754
  Synthetic: C terminal HlyA secretion Tag

SEQ ID NO: 842 - DNA, 2124 bp, Artificial Sequence
  Synthetic: HlyB coding sequence
atggattcttgtcataaaattgattatgggttatacgccctggagattttagcccaataccataacgtctctgttaacccggaagaaattaaacatagatttgacacagacgggactggtctgggattaacgtcatggttgcttgctgcgaaatctttagaactaaaggtaaaacaggtaaaaaaaacaattgaccgattaaactttatttctttgcccgcattagtctggagagaggatggacgtcattttattctgactaaagtcagtaaagaagcaaacagatatcttatttttgatctggagcaacgaaatccccgtgttctcgaacagtctgagtttgaggcgttatatcaggggcatattattcttattgcttcccgttcttctgttaccgggaaactggcaaaatttgactttacctggtttatccctgccattataaaatacagaaaaatatttattgaaacccttgttgtatctgtttttttacaattatttgcattaataaccccccttttttttcaggtggttatggacaaagtattagtacacagggggttttcaacccttaatgttattactgtcgcattatctgttgtggtggtgtttgagattatactcagcggtttaagaacttacatttttgcacatagtacaagtcggattgatgttgagttgggtgccaaactcttccggcatttactggcgctaccgatctcttattttgagagtcgtcgtgttggtgatactgttgccagggtaagagaattagaccagatccgtaattttctgacaggacaggcattaacatctgttctggacttattattttcattcatattttttgcggtaatgtggtattacagcccaaagcttactctggtgatcttattttcgctgccctgttatgctgcatggtctgtttttattagccccattttgcgacgtcgccttgatgataagttttcacggaatgcggataatcaatctttcctggtggaatcagtcacggcgattaacactataaaagctatggcagtctcacctcagatgacgaacatatgggacaaacaattggcaggatatgttgctgcaggctttaaagtgacagtattagccaccattggtcaacaaggaatacagttaatacaaaagactgttatgatcatcaacctgtggttgggagcacacctggttatttccggggatttaagtattggtcagttaattgcttttaatatgcttgctggtcagattgttgcaccggttattcgccttgcacaaatctggcaggatttccagcaggttggtatatcagttacccgccttggtgatgtgcttaactctccaactgaaagttatcatgggaaactggcattaccggaaattaatggtaatatcacttttcgtaatatccggtttcgctataagcctgactctccggttattttagataatatcaatctcagtattaagcagggggaggttattggtattgtcggacgttctggttcaggaaaaagcacattaactaaattaattcaacgtttttatattcctgaaaatggccaggtcttaattgatggacatgatcttgcgttggccgatcctaactggttacgtcgtcaggtgggggttgtgttgcaggacaatgtgctgcttaatcgcagtattattgataatatctcactggctaatcctggtatgtccgtcgaaaaagttatttatgcagcgaaattagcaggcgctcatgattttatttctgaattgcgtgaggggtataacaccattgtcggggaacagggggcaggattatccggaggtcaacgtcaacgcatcgcaattgcaagggcgctggtgaacaaccctaaaatacttatttttgatgaagcaaccagtgctctggattatgagtcggagcatatcatcatgcgcaatatgcacaaaatatgtaagggcagaacggttataatcattgctcatcgtctgtctacagtaaaaaatgcagaccgcattattgtcatggaaaaagggaaaattgttgaacagggtaaacataaggaactgctttctgaaccggaaagtttatacagttacttatatcagttacagtcagactaa

SEQ ID NO: 843 - DNA, 1437 bp, Artificial Sequence
  Synthetic: HlyD coding sequence
atgaaaacatggttaatggggttcagcgagttcctgttgcgctataaacttgtctggagtgaaacatggaaaatccggaagcaattagatactccggtacgtgaaaaggacgaaaatgaattcttacccgctcatctggaattaattgaaacgccggtatccagacggccgcgtctggttgcttattttattatggggtttctggttattgctgtcattttatctgttttaggtcaggtggaaattgttgccactgcaaatgggaaattaacactaagtgggcgcagcaaagaaattaaacctattgaaaactcaatagttaaagaaattatcgtaaaagaaggagagtcagtccggaaaggggatgtgttattaaagcttacagcactgggagctgaagctgatacgttaaaaacacagtcatcactgttacagaccaggctggaacaaactcggtatcaaattctgagcaggtcaattgaattaaataaactacctgaactgaagcttcctgatgagccttattttcagaatgtatctgaagaggaagtactgcgtttaacttctttgataaaagaacagttttccacatggcaaaatcagaagtatcaaaaagaactgaatctggataagaaaagagcagagcgattaacaatacttgcccgtataaaccgttatgaaaatttatcgagagttgaaaaaagccgtctggatgatttcaggagtttattgcataaacaggcaattgcaaaacatgctgtacttgagcaggagaataaatatgtcgaggcagcaaatgaattacgggtttataaatcgcaactggagcaaattgagagtgagatattgtctgcaaaagaagaatatcagcttgtcacgcagctttttaaaaatgaaattttagacaagctaagacaaacaacagacaacattgagttattaactctggagttagagaaaaatgaagagcgtcaacaggcttcagtaatcagggcccctgtttcgggaaaagttcagcaactgaaggttcatactgaaggtggggttgttacaacagcggaaacactgatggtcatcgttccggaagatgacacgctggaggttactgctctggtacaaaataaagatattggttttattaacgtcgggcagaatgccatcattaaagtggaggcctttccttacacccgatatggttatctggtgggtaaggtgaaaaatataaatttagatgcaatagaagaccagaaactgggactcgtttttaatgtcattgtttctgttgaagagaatgatttgtcaaccgggaataagcacattccattaagctcgggtatggctgtcactgcagaaataaagactggaatgcgaagcgtaatcagctatcttcttagtcctctggaagagtctgtaacagaaagtttacatgagcgttaa

SEQ ID NO: 844 - protein, 119 aa, Artificial Sequence
  Synthetic: Anti-CTLA-4 Heavy
MQVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 845 - protein, 108 aa, Artificial Sequence; identical to SEQ ID NO: 8
  Synthetic: Anti-CTLA-4 Light

SEQ ID NO: 846 - protein, 114 aa, Artificial Sequence
  Synthetic: Anti-PD-1 Heavy
MQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSS

SEQ ID NO: 847 - protein, 107 aa, Artificial Sequence [sequence omitted]

SEQ ID NO: 848 - protein, 109 aa, Artificial Sequence
  Synthetic: Anti-PD-L1 Light
MDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKR

SEQ ID NO: 849 - protein, 118 aa, Artificial Sequence [sequence omitted]

SEQ ID NO: 850 - protein, 15 aa, Artificial Sequence
  Synthetic: Linker
GGGSGGGSGGGSGGG

SEQ ID NO: 851 - protein, 59 aa, Artificial Sequence
  Synthetic: N Terminal Secretion Tag For Type V Auto-secreter Secretion
MNKVYSLKYCPVTGGLIVVSELASRVIKKTCRRLTHILLAGIPAVYLYYPQISQAGIVR

SEQ ID NO: 852 - protein, 162 aa, Artificial Sequence
  Synthetic: C Terminal Secretion Tag For Type V Auto-secreter Secretion
FKAEADKAAAAKADSFMNAGYKNFMTEVNNLNKRMGDLRDTNGDAGAWARIMSGAGSADGGYSDNYTHVQVGFDKKHELDGVDLFTGVTMTYTDSSADSHAFSGKTKSVGGGLYASALFESGAYIDLIGKYIHHDNDYTGNFAGLGTKHYNTHSWYAGAETG

SEQ ID NO: 853 - protein, 52 aa, Artificial Sequence; identical to SEQ ID NO: 753
  Synthetic: C-Terminal HlyA Secretion Tag

SEQ ID NO: 854 - protein, 707 aa, Artificial Sequence
  Synthetic: HlyB
MDSCHKIDYGLYALEILAQYHNVSVNPEEIKHRFDTDGTGLGLTSWLLAAKSLELKVKQVKKTIDRLNFISLPALVWREDGRHFILTKVSKEANRYLIFDLEQRNPRVLEQSEFEALYQGHIILIASRSSVTGKLAKFDFTWFIPAIIKYRKIFIETLVVSVFLQLFALITPLFFQVVMDKVLVHRGFSTLNVITVALSVVVVFEIILSGLRTYIFAHSTSRIDVELGAKLFRHLLALPISYFESRRVGDTVARVRELDQIRNFLTGQALTSVLDLLFSFIFFAVMWYYSPKLTLVILFSLPCYAAWSVFISPILRRRLDDKFSRNADNQSFLVESVTAINTIKAMAVSPQMTNIWDKQLAGYVAAGFKVTVLATIGQQGIQLIQKTVMIINLWLGAHLVISGDLSIGQLIAFNMLAGQIVAPVIRLAQIWQDFQQVGISVTRLGDVLNSPTESYHGKLALPEINGNITFRNIRFRYKPDSPVILDNINLSIKQGEVIGIVGRSGSGKSTLTKLIQRFYIPENGQVLIDGHDLALADPNWLRRQVGVVLQDNVLLNRSIIDNISLANPGMSVEKVIYAAKLAGAHDFISELREGYNTIVGEQGAGLSGGQRQRIAIARALVNNPKILIFDEATSALDYESEHIIMRNMHKICKGRTVIIIAHRLSTVKNADRIIVMEKGKIVEQGKHKELLSEPESLYSYLYQLQSD

SEQ ID NO: 855 - protein, 478 aa, Artificial Sequence
  Synthetic: HlyD
MKTWLMGFSEFLLRYKLVWSETWKIRKQLDTPVREKDENEFLPAHLELIETPVSRRPRLVAYFIMGFLVIAVILSVLGQVEIVATANGKLTLSGRSKEIKPIENSIVKEIIVKEGESVRKGDVLLKLTALGAEADTLKTQSSLLQTRLEQTRYQILSRSIELNKLPELKLPDEPYFQNVSEEEVLRLTSLIKEQFSTWQNQKYQKELNLDKKRAERLTILARINRYENLSRVEKSRLDDFRSLLHKQAIAKHAVLEQENKYVEAANELRVYKSQLEQIESEILSAKEEYQLVTQLFKNEILDKLRQTTDNIELLTLELEKNEERQQASVIRAPVSGKVQQLKVHTEGGVVTTAETLMVIVPEDDTLEVTALVQNKDIGFINVGQNAIIKVEAFPYTRYGYLVGKVKNINLDAIEDQKLGLVFNVIVSVEENDLSTGNKHIPLSSGMAVTAEIKTGMRSVISYLLSPLEESVTESLHER

SEQ ID NO: 856 - DNA, 213 bp, Artificial Sequence
  Synthetic: PfnrS
ggtaccagttgttcttattggtggtgttgctttatggttgcatcgtagtaaatggttgtaacaaaagcaatttttccggctgtctgtatacaaaaacgccgtaaagtttgagcgaagtcaataaactctctacccattcagggcaatatctctcttggatccaaagtgaactctagaaataattttgtttaactttaagaaggagatatacat

SEQ ID NO: 857 - DNA, 1455 bp, Artificial Sequence
  Synthetic: PfnrS-nupC
ggtaccagttgttcttattggtggtgttgctttatggttgcatcgtagtaaatggttgtaacaaaagcaatttttccggctgtctgtatacaaaaacgccgtaaagtttgagcgaagtcaataaactctctacccattcagggcaatatctctcttggatccaaagtgaactctagaaataattttgtttaactttaagaaggagatatacatgtgcacggaaatttaacctgcctcatatttggagcaaatatggaccgcgtccttcattttgtactggcacttgccgttgttgcgattctcgcactgctggtaagcagcgaccgcaaaaaaattcgtatccgttatgttattcaactgcttgttatcgaagtgttactggcgtggttcttcctgaactccgacgttggtctgggcttcgtgaaaggcttctccgaaatgttcgaaaaactgctcggttttgccaacgaagggactaacttcgtctttggtagcatgaatgatcaaggcctggcattcttcttcctgaaagtgctgtgcccaatcgtctttatctctgcgctgatcggtattctccagcatattcgcgtattgccggtgattatccgcgcaattggtttcctgctctccaaagtcaacggcatgggcaaactggaatcctttaacgccgtcagctccctgattctgggtcagtctgaaaactttattgcctataaagatatcctcggcaaaatctcccgcaatcgtatgtacaccatggcagcaacggcgatgtccaccgtgtcgatgtccatcgttggtgcatatatgaccatgctggagccgaaatacgtcgttgcggcgctggtactgaacatgttcagcacctttatcgtgctgtcgctgatcaacccttaccgtgttgatgccagtgaagaaaacattcagatgtccaacctgcacgaaggtcagagcttcttcgaaatgctgggtgaatacattctggcaggtttcaaagttgccattatcgttgccgcgatgctgatcggctttatcgccctgatcgctgcactgaacgctctgtttgctaccgtgactggctggtttggctacagcatctccttccagggcatcctgggttacatcttctatccgattgcatgggtgatgggtgttccttccagtgaagcactgcaagtgggcagtatcatggcgaccaaactggtttccaacgagttcgttgcgatgatggatctgcagaaaattgcttccacgctctctccgcgtgcggaaggcatcatctctgtgttcctggtttccttcgctaacttctcttcaatcgggattatcgcgggtgcggttaaaggcctgaatgaagagcaaggtaacgtggtttctcgcttcggtctgaaactggtttacggctctaccctggtgagtgtgctgtctgcgtcaatcgcagcactggtgctgtaa

SEQ ID NO: 858 - DNA, 3837 bp, Artificial Sequence
  Synthetic: PfnrS-xdhABC
ggtaccagttgttcttattggtggtgttgctttatggttgcatcgtagtaaatggttgtaacaaaagcaatttttccggctgtctgtatacaaaaacgccgtaaagtttgagcgaagtcaataaactctctacccattcagggcaatatctctcttggatccaaagtgaactctagaaataattttgtttaactttaagaaggagatatacatatgcgcgtcgatgccattgctaaggtcaccgggcgggcacgatatactgacgattatattatggcgggcatgtgttacgcgaaatatgtacgtagccctatcgcacatggttatgctgtaaatattaatgatgaacaagccaggagtttgccgggcgtcctggcgatttttacctgggaagatgtgccagaaatcccattcgccacggcagggcatgcctggacacttgacgaaaacaagcgcgataccgccgatcgtgccctgctaacgcgtcatgttcgtcatcatggtgacgccgttgccatcgtcgtggcccgcgatgaactcacggcagaaaaagcggcgcaattggtcagcattgagtggcaagaattacccgttatcacctcgccagaagcggcgctggcagaagacgctgcaccaatccataacggtggcaatttactgaaacaaagcacgatgtcgacgggtaatgtccaacaaacaatcgatgccgccgactaccaggtacaggggcactatcagactcccgttattcaacattgtcatatggaaagcgtgacatcgctggcatggatggaggatgactcgcgaattaccatcgtttccagcacccagatcccgcacattgttcgccgcgtggttggtcaggcgctggatattccctggtcatgcgtacgagtcatcaaaccgtttatcggtggcggttttggtaataaacaggatgtactggaagagccaatggcggcattcctgaccagcaaacttggcggcattccggtgaaagtttcccttagccgtgaagagtgtttcctcgcaacccgtacccgccacgcttttactattgacgggcaaatgggcgtgaaccgcgacggaacattgaaaggttatagtctggatgttctgtctaacaccggcgcttatgcatctcacgggcactccattgcttctgctggggggaataaagtcgcttacctttatcctcgttgtgcctacgcttacagttcaaagacctgctataccaacctcccctcggctggtgcgatgcgtggttatggcgcgccacaagtcgtatttgccgttgagtctatgcttgatgatgccgcgacagcgttaggtattgatcctgttgaaattcgtttacgcaacgccgcccgcgaaggagatgctaatccgctcacgggaaaacgtatttacagcgcagggttgccggagtgtcttgaaaaaggccggaaaatctttgaatgggaaaaacgccgtgcagagtgccagaaccagcaaggcaatttacgtcgtggcgttggcgtcgcctgttttagctacacctctaacacctggcctgtcggcgtagaaatagcaggcgcgcgcctgttgatgaatcaggatggaaccatcaacgtgcaaagcggcgcgacggaaatcggccagggtgccgacaccgtgttctcgcaaatggtggcagaaaccgtgggagttccggtcagcgatgttcacgttatttcaacccaagataccgacgttacaccattcgaccccggcgcatttgcctcacgtcagagctatgttgccgcgcctgcgctgcgcagtgcagcactgttattaaaagagaaaatcatcgctcacgccgcagtcatgctacatcagtcagcgatgaatctgaccctgataaaaggccatatcgtgctgattgaaagaccggaagaaccgttaatgtcgttaaaagatttggcgatggacgctttctaccaccctgaacgcggcgggcagctctctgccgaaagctccatcaaaaccaccactaacccaccggcgtttggctgtacctttgttgatctgacggtcgatattgcactgtgcaaagtcaccatcaaccgcatcctcaacgttcatgattcgggccatattcttaatccgctgctggcagaaggtcaggtacacggcggaatgggaatgggcattggctgggcgctatttgaagagatgatcatcgatgcgaaaagcggcgtggtccgtaaccccaatctgctggattacaaaatgccgaccatgccggatctgccacaactggaaagcgcgttcgtcgaaatcaatgagccgcaatcagcatacggacataagtcactgggtgagccccccataattcctgtagccgctgctattcgtaacgcggtgaagatggctaccggtgttgcaatcaatacactgccgctaacgccaaaacgattatatgaagaattccatctggcaggattgatttgaggataacatcatgtttgattttgcttcttaccatcgcgcaaccacccttgccgatgccatcaccctgctggctgacaatccgcaggccaaattgcttgccggtggcactgacgtactgatacagcttcaccatcacaatgaccgctatcgccatattgttgatatccacaatctggcagagcttcagggaataacacaggcggaagatggcgcgctgcgaatcggctctgcgacaacatttactcagctcattgaagatcccgtaatccaacgcaatctcccggcgttatgtgctgcggctgcatcaatcgccgggccgcagatccgtaatgtcgccacctacggcggaaatatttgcaacggtgccaccagcgcagattctgccacgccaacgctaatttatgacgcgaaactggagctccactccccacgcggtgttcgtttcgtcccgattaatggctttcacaccgggccgggcaaagtgtctcttgagcatgacgaaatccttgtcgcctttcattttccgccacagccgaaagaacacgcgggcagcgcgcattttaaatatgccatgcgcgacgcaatggatatttcaacaattggctgcgccgcacattgccgactggataacggcaatttcagcgaattacgcctggcatttggtgttgccgcgccaacgccgattcgctgccaacatgccgaacagactgcacaaaatgcgccattaaacctgcaaacgctggaagccatcagcgaatcagtcctgcaagatgtcgccccgcgttcttcatggcgggccagtaaagagtttcgtctgcatctcatccagacgatgaccaaaaaagtgattagcgaagccgtcgccgcggcggggggaaaattgcaatgaatcacagcgaaacaattaccatcgaatgcaccattaacgggatgccttttcagcttcacgccgcgccaggaatgccgctttcggaactactccgagaacaagggcttcttagtgtcaaacaaggttgctgcgtaggcgaatgcggtgcctgtacggtgctggtcgacggcactgcgatagacagttgcttattccttgcgacctgggctgaaggaaaagagatccgcacgctggaaggtgaagcgaaaggcggtaaactttctcatgtccaactggcttatgcgaaatctggtgcagtgcaatgcgggttttgtacgccgggcctgattatggctaccacggcgatgctggcaaaaccacgcgaaaaaccattaaccattacggaaattcgtcgtggactggcgggaaatctttgtcgctgcacggggtatcagatgattgtaaatacagttctggattgcgagaaaacgaagtaa

SEQ ID NO: 859 - DNA, 3624 bp, Artificial Sequence
  Synthetic: xdhABC
atgcgcgtcgatgccattgctaaggtcaccgggcgggcacgatatactgacgattatattatggcgggcatgtgttacgcgaaatatgtacgtagccctatcgcacatggttatgctgtaaatattaatgatgaacaagccaggagtttgccgggcgtcctggcgatttttacctgggaagatgtgccagaaatcccattcgccacggcagggcatgcctggacacttgacgaaaacaagcgcgataccgccgatcgtgccctgctaacgcgtcatgttcgtcatcatggtgacgccgttgccatcgtcgtggcccgcgatgaactcacggcagaaaaagcggcgcaattggtcagcattgagtggcaagaattacccgttatcacctcgccagaagcggcgctggcagaagacgctgcaccaatccataacggtggcaatttactgaaacaaagcacgatgtcgacgggtaatgtccaacaaacaatcgatgccgccgactaccaggtacaggggcactatcagactcccgttattcaacattgtcatatggaaagcgtgacatcgctggcatggatggaggatgactcgcgaattaccatcgtttccagcacccagatcccgcacattgttcgccgcgtggttggtcaggcgctggatattccctggtcatgcgtacgagtcatcaaaccgtttatcggtggcggttttggtaataaacaggatgtactggaagagccaatggcggcattcctgaccagcaaacttggcggcattccggtgaaagtttcccttagccgtgaagagtgtttcctcgcaacccgtacccgccacgcttttactattgacgggcaaatgggcgtgaaccgcgacggaacattgaaaggttatagtctggatgttctgtctaacaccggcgcttatgcatctcacgggcactccattgcttctgctggggggaataaagtcgcttacctttatcctcgttgtgcctacgcttacagttcaaagacctgctataccaacctcccctcggctggtgcgatgcgtggttatggcgcgccacaagtcgtatttgccgttgagtctatgcttgatgatgccgcgacagcgttaggtattgatcctgttgaaattcgtttacgcaacgccgcccgcgaaggagatgctaatccgctcacgggaaaacgtatttacagcgcagggttgccggagtgtcttgaaaaaggccggaaaatctttgaatgggaaaaacgccgtgcagagtgccagaaccagcaaggcaatttacgtcgtggcgttggcgtcgcctgttttagctacacctctaacacctggcctgtcggcgtagaaatagcaggcgcgcgcctgttgatgaatcaggatggaaccatcaacgtgcaaagcggcgcgacggaaatcggccagggtgccgacaccgtgttctcgcaaatggtggcagaaaccgtgggagttccggtcagcgatgttcacgttatttcaacccaagataccgacgttacaccattcgaccccggcgcatttgcctcacgtcagagctatgttgccgcgcctgcgctgcgcagtgcagcactgttattaaaagagaaaatcatcgctcacgccgcagtcatgctacatcagtcagcgatgaatctgaccctgataaaaggccatatcgtgctgattgaaagaccggaagaaccgttaatgtcgttaaaagatttggcgatggacgctttctaccaccctgaacgcggcgggcagctctctgccgaaagctccatcaaaaccaccactaacccaccggcgtttggctgtacctttgttgatctgacggtcgatattgcactgtgcaaagtcaccatcaaccgcatcctcaacgttcatgattcgggccatattcttaatccgctgctggcagaaggtcaggtacacggcggaatgggaatgggcattggctgggcgctatttgaagagatgatcatcgatgcgaaaagcggcgtggtccgtaaccccaatctgctggattacaaaatgccgaccatgccggatctgccacaactggaaagcgcgttcgtcgaaatcaatgagccgcaatcagcatacggacataagtcactgggtgagccccccataattcctgtagccgctgctattcgtaacgcggtgaagatggctaccggtgttgcaatcaatacactgccgctaacgccaaaacgattatatgaagaattccatctggcaggattgatttgaggataacatcatgtttgattttgcttcttaccatcgcgcaaccacccttgccgatgccatcaccctgctggctgacaatccgcaggccaaattgcttgccggtggcactgacgtactgatacagcttcaccatcacaatgaccgctatcgccatattgttgatatccacaatctggcagagcttcagggaataacacaggcggaagatggcgcgctgcgaatcggctctgcgacaacatttactcagctcattgaagatcccgtaatccaacgcaatctcccggcgttatgtgctgcggctgcatcaatcgccgggccgcagatccgtaatgtcgccacctacggcggaaatatttgcaacggtgccaccagcgcagattctgccacgccaacgctaatttatgacgcgaaactggagctccactccccacgcggtgttcgtttcgtcccgattaatggctttcacaccgggccgggcaaagtgtctcttgagcatgacgaaatccttgtcgcctttcattttccgccacagccgaaagaacacgcgggcagcgcgcattttaaatatgccatgcgcgacgcaatggatatttcaacaattggctgcgccgcacattgccgactggataacggcaatttcagcgaattacgcctggcatttggtgttgccgcgccaacgccgattcgctgccaacatgccgaacagactgcacaaaatgcgccattaaacctgcaaacgctggaagccatcagcgaatcagtcctgcaagatgtcgccccgcgttcttcatggcgggccagtaaagagtttcgtctgcatctcatccagacgatgaccaaaaaagtgattagcgaagccgtcgccgcggcggggggaaaattgcaatgaatcacagcgaaacaattaccatcgaatgcaccattaacgggatgccttttcagcttcacgccgcgccaggaatgccgctttcggaactactccgagaacaagggcttcttagtgtcaaacaaggttgctgcgtaggcgaatgcggtgcctgtacggtgctggtcgacggcactgcgatagacagttgcttattccttgcgacctgggctgaaggaaaagagatccgcacgctggaaggtgaagcgaaaggcggtaaactttctcatgtccaactggcttatgcgaaatctggtgcagtgcaatgcgggttttgtacgccgggcctgattatggctaccacggcgatgctggcaaaaccacgcgaaaaaccattaaccattacggaaattcgtcgtggactggcgggaaatctttgtcgctgcacggggtatcagatgattgtaaatacagttctggattgcgagaaaacgaagtaa

SEQ ID NO: 860 - DNA, 2803 bp, Artificial Sequence
  Synthetic: PfnrS-add-xapA-deoD
ggtaccagttgttcttattggtggtgttgctttatggttgcatcgtagtaaatggttgtaacaaaagcaatttttccggctgtctgtatacaaaaacgccgtaaagtttgagcgaagtcaataaactctctacccattcagggcaatatctctcttggatccaaagtgaactctagaaataattttgtttaactttaagaaggagatatacatatgattgataccaccctgccattaactgatatccatcgccaccttgatggcaacattcgtccccagaccattcttgaacttggccgccagtataatatctcgcttcctgcacaatccctggaaacactgattccccacgttcaggtcattgccaacgaacccgatctggtgagctttctgactaaacttgactggggcgttaaagttctcgcctctcttgatgcctgccgccgcgtggcatttgaaaacattgaagatgcagcccgtaacggcctgcactatgtcgagctgcgtttttcaccaggctacatggcaatggcacatcagctgcctgtagcgggtgttgtcgaagcggtgatcgatggcgtacgtgaaggttgccgcacctttggtgtgcaggcgaagcttatcggtattatgagccggaccttcggcgaagccgcctgtcagcaagagctggaggcctttttagcccaccgtgaccagattaccgcacttgatttagccggtgatgaacttggtttcccgggaagtctgttcctttctcatttcaaccgcgcgcgtgatgcgggctggcatattaccgtccatgcaggcgaagctgccggaccggaaagcatctggcaggcgattcgtgaactgggggcggagcgtattggacatggcgtaaaagccattgaagatcgggcgctgatggattttctcgccgagcaacaaattggtattgaatcctgtctgacctccaatattcagaccagcaccgtggcggatctggctgcacatccgctgaaaacgttccttgagcatggcattcgtgccagcattaacactgacgatccaggcgtgcagggagtggatatcattcacgaatataccgttgccgcgccagctgctgggttatcccgcgagcaaatccgccaggcacagattaatggtctggaaatggctttcctcagcgcagaggaaaaacgcgcactgcgagaaaaagtcgccgcgaagtaaaagaaggagatatacatatgtatcaggctcagttttctcataacccactgtattgcgtagatattatcaagacttataaacctgatttcacgccacgagtggcctttattttaggttccgggctgggcgcgctggccgatcagattgagaacgcggtcgcaatttcctacgaaaagctgcctgggttcccggtaagtaccgtacacggtcatgcgggtgagctggtgctgggttatctccagggggtgccagtggcgtgtatgaaaggtcgcggacatttctacgaaggtcgtgggatgaccatcatgacggatgcaatccgtacctttaagttgctgggctgcgagttgctgttctgcaccaatgcggctggctcactgcgccctgaagtgggggccggcagtctggtcgcattgaaagatcacatcaacaccatgccgggaacgccgatggtgggtcttaatgatgaacgttttggtgagcgcttcttctcgctggcgaatgcctacgatgcggaataccgcgcactgttacaaaaagtggcgaaagaagaggggttccctctgacggagggcgtgttcgtctcatatccggggccgaatttcgagactgcggcggaaattcgcatgatgcaaattattggtggggatgttgttggtatgtctgtggtgcctgaggttatttcagctcgccattgcgaacttaaagtcgttgcggtctctgcgattaccaacatggcggaaggtctgagtgacgtgaagctttctcatgcccaaacgctggcagcagcggaactctcaaagcaaaactttattaatcttatttgcggctttctgcgcaaaattgcctgaaagaaggagatatacatatggctaccccacacattaatgcagaaatgggcgatttcgctgacgtagttttgatgccaggcgacccgctgcgtgcgaagtatattgctgaaactttccttgaagatgcccgtgaagtgaacaacgttcgcggtatgctgggcttcaccggtacttacaaaggccgcaaaatttccgtaatgggtcacggtatgggtatcccgtcctgctccatctacaccaaagaactgatcaccgatttcggcgtgaagaaaattatccgcgtgggttcctgtggcgcagttctgccgcacgtaaaactacgcgacgtcgttatcggtatgggtgcctgcaccgattccaaagttaaccgcatccgttttaaagaccatgactttgccgctatcgctgactttgacatggtgcgtaacgcggtagacgcggctaaagcactgggcgttgatgctcgcgtgggtaacctgttctccgctgacctgttctactctccggacggcgaaatgttcgacgtgatggaaaaatacggcatcctcggcgtggaaatggaagcggctggtatctacggcgtcgctgcagaatttggcgcgaaagccctgaccatctgcaccgtgtctgaccacatccgcactcacgagcagaccactgccgctgagcgtcagaccaccttcaacgacatgatcaaaatcgcactggaatccgttctgctgggcgataaagagtaa

SEQ ID NO: 861 - DNA, 2633 bp, Artificial Sequence
  Synthetic: add-xapA-deoD
ctctagaaataattttgtttaactttaagaaggagatatacatatgattgataccaccctgccattaactgatatccatcgccaccttgatggcaacattcgtccccagaccattcttgaacttggccgccagtataatatctcgcttcctgcacaatccctggaaacactgattccccacgttcaggtcattgccaacgaacccgatctggtgagctttctgactaaacttgactggggcgttaaagttctcgcctctcttgatgcctgccgccgcgtggcatttgaaaacattgaagatgcagcccgtaacggcctgcactatgtcgagctgcgtttttcaccaggctacatggcaatggcacatcagctgcctgtagcgggtgttgtcgaagcggtgatcgatggcgtacgtgaaggttgccgcacctttggtgtgcaggcgaagcttatcggtattatgagccggaccttcggcgaagccgcctgtcagcaagagctggaggcctttttagcccaccgtgaccagattaccgcacttgatttagccggtgatgaacttggtttcccgggaagtctgttcctttctcatttcaaccgcgcgcgtgatgcgggctggcatattaccgtccatgcaggcgaagctgccggaccggaaagcatctggcaggcgattcgtgaactgggggcggagcgtattggacatggcgtaaaagccattgaagatcgggcgctgatggattttctcgccgagcaacaaattggtattgaatcctgtctgacctccaatattcagaccagcaccgtggcggatctggctgcacatccgctgaaaacgttccttgagcatggcattcgtgccagcattaacactgacgatccaggcgtgcagggagtggatatcattcacgaatataccgttgccgcgccagctgctgggttatcccgcgagcaaatccgccaggcacagattaatggtctggaaatggctttcctcagcgcagaggaaaaacgcgcactgcgagaaaaagtcgccgcgaagtaaaagaaggagatatacatatgtatcaggctcagttttctcataacccactgtattgcgtagatattatcaagacttataaacctgatttcacgccacgagtggcctttattttaggttccgggctgggcgcgctggccgatcagattgagaacgcggtcgcaatttcctacgaaaagctgcctgggttcccggtaagtaccgtacacggtcatgcgggtgagctggtgctgggttatctccagggggtgccagtggcgtgtatgaaaggtcgcggacatttctacgaaggtcgtgggatgaccatcatgacggatgcaatccgtacctttaagttgctgggctgcgagttgctgttctgcaccaatgcggctggctcactgcgccctgaagtgggggccggcagtctggtcgcattgaaagatcacatcaacaccatgccgggaacgccgatggtgggtcttaatgatgaacgttttggtgagcgcttcttctcgctggcgaatgcctacgatgcggaataccgcgcactgttacaaaaagtggcgaaagaagaggggttccctctgacggagggcgtgttcgtctcatatccggggccgaatttcgagactgcggcggaaattcgcatgatgcaaattattggtggggatgttgttggtatgtctgtggtgcctgaggttatttcagctcgccattgcgaacttaaagtcgttgcggtctctgcgattaccaacatggcggaaggtctgagtgacgtgaagctttctcatgcccaaacgctggcagcagcggaactctcaaagcaaaactttattaatcttatttgcggctttctgcgcaaaattgcctgaaagaaggagatatacatatggctaccccacacattaatgcagaaatgggcgatttcgctgacgtagttttgatgccaggcgacccgctgcgtgcgaagtatattgctgaaactttccttgaagatgcccgtgaagtgaacaacgttcgcggtatgctgggcttcaccggtacttacaaaggccgcaaaatttccgtaatgggtcacggtatgggtatcccgtcctgctccatctacaccaaagaactgatcaccgatttcggcgtgaagaaaattatccgcgtgggttcctgtggcgcagttctgccgcacgtaaaactacgcgacgtcgttatcggtatgggtgcctgcaccgattccaaagttaaccgcatccgttttaaagaccatgactttgccgctatcgctgactttgacatggtgcgtaacgcggtagacgcggctaaagcactgggcgttgatgctcgcgtgggtaacctgttctccgctgacctgttctactctccggacggcgaaatgttcgacgtgatggaaaaatacggcatcctcggcgtggaaatggaagcggctggtatctacggcgtcgctgcagaatttggcgcgaaagccctgaccatctgcaccgtgtctgaccacatccgcactcacgagcagaccactgccgctgagcgtcagaccaccttcaacgacatgatcaaaatcgcactggaatccgttctgctgggcgataaagagtaa

SEQ ID NO: 862 - DNA, 1053 bp, Artificial Sequence
  Synthetic: fbrAroG
atgaattatcagaacgacgatttacgcatcaaagaaatcaaagagttacttcctcctgtcgcattgctggaaaaattccccgctactgaaaatgccgcgaatacggtcgcccatgcccgaaaagcgatccataagatcctgaaaggtaatgatgatcgcctgttggtggtgattggcccatgctcaattcatgatcctgtcgcggctaaagagtatgccactcgcttgctgacgctgcgtgaagagctgcaagatgagctggaaatcgtgatgcgcgtctattttgaaaagccgcgtactacggtgggctggaaagggctgattaacgatccgcatatggataacagcttccagatcaacgacggtctgcgtattgcccgcaaattgctgctcgatattaacgacagcggtctgccagcggcgggtgaattcctggatatgatcaccctacaatatctcgctgacctgatgagctggggcgcaattggcgcacgtaccaccgaatcgcaggtgcaccgcgaactggcgtctggtctttcttgtccggtaggtttcaaaaatggcactgatggtacgattaaagtggctatcgatgccattaatgccgccggtgcgccgcactgcttcctgtccgtaacgaaatgggggcattcggcgattgtgaataccagcggtaacggcgattgccatatcattctgcgcggcggtaaagagcctaactacagcgcgaagcacgttgctgaagtgaaagaagggctgaacaaagcaggcctgccagcgcaggtgatgatcgatttcagccatgctaactcgtcaaaacaattcaaaaagcagatggatgtttgtactgacgtttgccagcagattgccggtggcgaaaaggccattattggcgtgatggtggaaagccatctggtggaaggcaatcagagcctcgagagcggggaaccgctggcctacggtaagagcatcaccgatgcctgcattggctgggatgataccgatgctctgttacgtcaactggcgagtgcagtaaaagcgcgtcgcgggtaa

SEQ ID NO: 863 - DNA, 2351 bp, Artificial Sequence
  Synthetic: fbrAroG-serA
ctctagaaataattttgtttaactttaagaaggagatatacatatgaattatcagaacgacgatttacgcatcaaagaaatcaaagagttacttcctcctgtcgcattgctggaaaaattccccgctactgaaaatgccgcgaatacggtcgcccatgcccgaaaagcgatccataagatcctgaaaggtaatgatgatcgcctgttggtggtgattggcccatgctcaattcatgatcctgtcgcggctaaagagtatgccactcgcttgctgacgctgcgtgaagagctgcaagatgagctggaaatcgtgatgcgcgtctattttgaaaagccgcgtactacggtgggctggaaagggctgattaacgatccgcatatggataacagcttccagatcaacgacggtctgcgtattgcccgcaaattgctgctcgatattaacgacagcggtctgccagcggcgggtgaattcctggatatgatcaccctacaatatctcgctgacctgatgagctggggcgcaattggcgcacgtaccaccgaatcgcaggtgcaccgcgaactggcgtctggtctttcttgtccggtaggtttcaaaaatggcactgatggtacgattaaagtggctatcgatgccattaatgccgccggtgcgccgcactgcttcctgtccgtaacgaaatgggggcattcggcgattgtgaataccagcggtaacggcgattgccatatcattctgcgcggcggtaaagagcctaactacagcgcgaagcacgttgctgaagtgaaagaagggctgaacaaagcaggcctgccagcgcaggtgatgatcgatttcagccatgctaactcgtcaaaacaattcaaaaagcagatggatgtttgtactgacgtttgccagcagattgccggtggcgaaaaggccattattggcgtgatggtggaaagccatctggtggaaggcaatcagagcctcgagagcggggaaccgctggcctacggtaagagcatcaccgatgcctgcattggctgggatgataccgatgctctgttacgtcaactggcgagtgcagtaaaagcgcgtcgcgggtaatacttaagaaggagatatacatatggcaaaggtatcgctggagaaagacaagattaagtttctgctggtagaaggcgtgcaccaaaaggcgctggaaagccttcgtgcagctggttacaccaacatcgaatttcacaaaggcgcgctggatgatgaacaattaaaagaatccatccgcgatgcccacttcatcggcctgcgatcccgtacccatctgactgaagacgtgatcaacgccgcagaaaaactggtcgctattggctgtttctgtatcggaacaaatcaggttgatctggatgcggcggcaaagcgcgggatcccggtatttaacgcaccgttctcaaatacgcgctctgttgcggagctggtgattggcgaactgctgctgctattgcgcggcgtgccagaagccaatgctaaagcgcatcgtggcgtgtggaacaaactggcggcgggttcttttgaagcgcgcggcaaaaagctgggtatcatcggctacggtcatattggtacgcaattgggcattctggctgaatcgctgggaatgtatgtttacttttatgatattgaaaacaaactgccgctgggcaacgccactcaggtacagcatctttctgacctgctgaatatgagcgatgtggtgagtctgcatgtaccagagaatccgtccaccaaaaatatgatgggcgcgaaagagatttcgctaatgaagcccggctcgctgctgattaatgcttcgcgcggtactgtggtggatattccagcgctgtgtgacgcgctggcgagcaaacatctggcgggggcggcaatcgacgtattcccgacggaaccggcgaccaatagcgatccatttacctctccgctgtgtgaattcgacaatgtccttctgacgccacacattggcggttcgactcaggaagcgcaggagaatatcggcttggaagttgcgggtaaattgatcaagtattctgacaatggctcaacgctctctgcggtgaacttcccggaagtctcgctgccactgcacggtgggcgtcgtctgatgcacatccacgaaaaccgtccgggcgtgctaactgcgctcaacaaaatttttgccgagcagggcgtcaacatcgccgcgcaatatctacaaacttccgcccagatgggttatgtagttattgatattgaagccgacgaagacgttgccgaaaaagcgctgcaggcaatgaaagctattccgggtaccattcgcgcccgtctgctgtactaa

SEQ ID NO: 864 - DNA, 1233 bp, Artificial Sequence
  Synthetic: SerA
atggcaaaggtatcgctggagaaagacaagattaagtttctgctggtagaaggcgtgcaccaaaaggcgctggaaagccttcgtgcagctggttacaccaacatcgaatttcacaaaggcgcgctggatgatgaacaattaaaagaatccatccgcgatgcccacttcatcggcctgcgatcccgtacccatctgactgaagacgtgatcaacgccgcagaaaaactggtcgctattggctgtttctgtatcggaacaaatcaggttgatctggatgcggcggcaaagcgcgggatcccggtatttaacgcaccgttctcaaatacgcgctctgttgcggagctggtgattggcgaactgctgctgctattgcgcggcgtgccagaagccaatgctaaagcgcatcgtggcgtgtggaacaaactggcggcgggttcttttgaagcgcgcggcaaaaagctgggtatcatcggctacggtcatattggtacgcaattgggcattctggctgaatcgctgggaatgtatgtttacttttatgatattgaaaacaaactgccgctgggcaacgccactcaggtacagcatctttctgacctgctgaatatgagcgatgtggtgagtctgcatgtaccagagaatccgtccaccaaaaatatgatgggcgcgaaagagatttcgctaatgaagcccggctcgctgctgattaatgcttcgcgcggtactgtggtggatattccagcgctgtgtgacgcgctggcgagcaaacatctggcgggggcggcaatcgacgtattcccgacggaaccggcgaccaatagcgatccatttacctctccgctgtgtgaattcgacaatgtccttctgacgccacacattggcggttcgactcaggaagcgcaggagaatatcggcttggaagttgcgggtaaattgatcaagtattctgacaatggctcaacgctctctgcggtgaacttcccggaagtctcgctgccactgcacggtgggcgtcgtctgatgcacatccacgaaaaccgtccgggcgtgctaactgcgctcaacaaaatttttgccgagcagggcgtcaacatcgccgcgcaatatctacaaacttccgcccagatgggttatgtagttattgatattgaagccgacgaagacgttgccgaaaaagcgctgcaggcaatgaaagctattccgggtaccattcgcgcccgtctgctgtactaa

SEQ ID NO: 865 - DNA, 1424 bp, Artificial Sequence
  Synthetic: Ptet-kynU(Pseudomonas)
atctaatctagacatcattaattcctaatttttgttgacactctatcattgatagagttattttaccactccctatcagtgatagagaaaagtgaattatataaaagtgggaggtgcccgaatgacgacccgaaatgattgcctagcgttggatgcacaggacagtctggctccgctgcgccaacaatttgcgctgccggagggtgtgatatacctggatggcaattcgctgggcgcacgtccggtagctgcgctggctcgcgcgcaggctgtgatcgcagaagaatggggcaacgggttgatccgttcatggaactctgcgggctggcgtgatctgtctgaacgcctgggtaatcgcctggctaccctgattggtgcgcgcgatggggaagtagttgttactgataccacctcgattaatctgtttaaagtgctgtcagcggcgctgcgcgtgcaagctacccgtagcccggagcgccgtgttatcgtgactgagacctcgaatttcccgaccgacctgtatattgcggaagggttggcggatatgctgcaacaaggttacactctgcgtttggtggattcaccggaagagctgccacaggctatagatcaggacaccgcggtggtgatgctgacgcacgtaaattataaaaccggttatatgcacgacatgcaggctctgaccgcgttgagccacgagtgtggggctctggcgatttgggatctggcgcactctgctggcgctgtgccggtggacctgcaccaagcgggcgcggactatgcgattggctgcacgtacaaatacctgaatggcggcccgggttcgcaagcgtttgtttgggtttcgccgcaactgtgcgacctggtaccgcagccgctgtctggttggttcggccatagtcgccaattcgcgatggagccgcgctacgaaccttctaacggcattgctcgctatctgtgcggcactcagcctattactagcttggctatggtggagtgcggcctggatgtgtttgcgcagacggatatggcttcgctgcgccgtaaaagtctggcgctgactgatctgttcatcgagctggttgaacaacgctgcgctgcacacgaactgaccctggttactccacgtgaacacgcgaaacgcggctctcacgtgtcttttgaacaccccgagggttacgctgttattcaagctctgattgatcgtggcgtgatcggcgattaccgtgagccacgtattatgcgtttcggtttcactcctctgtatactacttttacggaagtttgggatgcagtacaaatcctgggcgaaatcctggatcgtaagacttgggcgcaggctcagtttcaggtgcgccactctgttacttaaaaataaaacgaaaggctcagtcgaaagactgggcctttcgttttatctgttg

SEQ ID NO: 866 - DNA, 1571 bp, Artificial Sequence
  Synthetic: Ptet-kynU(Human)
atctaatctagacatcattaattcctaatttttgttgacactctatcattgatagagttattttaccactccctatcagtgatagagaaaagtgaatatcaagacacgaggaggtaagattatggagccttcatctttagaactgccagcggacacggtgcagcgcatcgcggcggaactgaagtgccatccgactgatgagcgtgtggcgctgcatctggacgaagaagataaactgcgccactttcgtgaatgtttttatattcctaaaattcaagacttgccgccggtagatttgagtctcgttaacaaagatgaaaacgcgatctactttctgggcaactctctgggtctgcaaccaaaaatggttaaaacgtacctggaggaagaactggataaatgggcaaaaatcgcggcttatggtcacgaagtgggcaagcgtccttggattactggcgacgagtctattgtgggtttgatgaaagatattgtgggcgcgaatgaaaaggaaattgcactgatgaatgctctgaccgttaatctgcacctgctgatgctgtctttttttaaaccgaccccgaaacgctacaaaatactgctggaagcgaaagcgtttccgtcggatcactatgctatagaaagtcaactgcagttgcatggtctgaatatcgaggaatctatgcgcatgattaaaccgcgtgagggtgaagaaacgctgcgtattgaagacattctggaagttattgaaaaagaaggtgattctatcgcagttatactgttttctggcgtgcacttttatacaggtcagcacttcaatatcccggcaatcactaaagcggggcaggcaaaaggctgctatgttggttttgacctggcgcatgcagtggggaatgttgaactgtatctgcacgattggggcgttgatttcgcgtgttggtgtagctacaaatatctgaacgctggcgcgggtggcattgctggcgcttttattcacgaaaaacacgcgcacaccattaaaccggctctggttggctggttcggtcatgagctgagtactcgctttaaaatggataacaaactgcaattgattccgggtgtttgcggcttccgtatcagcaatccgccgattctgctggtttgcagcctgcacgctagtctggaaatctttaagcaggcgactatgaaagcgctgcgcaaaaaatctgtgctgctgaccggctatctggagtatctgatcaaacacaattatggcaaagataaagctgcaactaaaaaaccggtagtgaacattatcaccccctcacacgtggaggagcgcggttgtcagctgactattactttcagtgtacctaataaagatgtgttccaggaactggaaaaacgcggcgttgtttgtgataaacgtaacccgaatggtattcgcgtggctcctgtgccgctgtacaattcattccacgatgtttataaattcaccaacctgctgacttctattctcgacagtgctgagactaaaaattaaaaataaaacgaaaggctcagtcgaaagactgggcctttcgttttatctgttg

SEQ ID NO: 867 - DNA, 1310 bp, Artificial Sequence
  Synthetic: ptet-kynU(Shewanella)
atctaatctagacatcattaattcctaatttttgttgacactctatcattgatagagttattttaccactccctatcagtgatagagaaaagtgaatggttcaccaccacaaggagggattatgctgctgaatgtaaaacaggacttttgcctggcaggcccgggctacctgctgaatcactcggttggccgtccgctgaaatcaactgagcaagcgctgaaacaagcattttttgctccgtggcaagagagcggtcgtgaaccgtggggccagtggctgggtgttattgataatttcactgctgcgctggcatctctgtttaatggtcaaccgcaggatttttgtccgcaggttaacctgagcagcgcgctgactaaaattgtgatgtcactggatcgtctgactcgcgatctgacccgcaatggcggtgctgttgtgctgatgtctgaaatcgatttcccatctatgggcttcgcgttgaaaaaagcgctgccagcgagctgcgaactgcgttttatcccgaaaagtctggacgtgactgatccgaacgtatgggatgcacacatctgtgatgatgtagacctggtttttgtgtctcacgcctatagtaatacgggccaacaggctccgctggcgcaaatcatctctctggcgcgtgaacgtggctgcctgtcactggtggatgtagcgcaatcagcggggattttgccgctggatctggcgaaactgcaaccggacttcatgatcggcagttcggttaaatggctgtgctcgggccctggtgcggcatatctgtgggttaatccggcgattctgccggaatgtcagccgcaggatgtgggctggttttcacatgagaatccctttgaattcgacatccacgatttccgctaccacccgactgcactgcgcttttggggtggtacgccgtcgatcgcgccttatgcgatcgcggcgcactcgatcgaatattttgccaatatcggctcgcaagtgatgcgtgaacacaacctgcaactgatggaaccggtggttcaggcgctggacaatgaactggtgagcccgcaggaagtggataaacgctcaggcactattattctgcaattcggtgaacgtcaaccgcaaattctggcggctctggctgcggcgaacatttcggtggacactcgttctttggggattcgtgttagtccgcacatttataatgatgaggcggacattgcgcgcctgctgggtgtgatcaaagcaaatcgctaaaaataaaacgaaaggctcagtcgaaagactgggcctttcgttttatctgttg

SEQ ID NO: 868 - DNA, 1096 bp, Artificial Sequence
  Synthetic: fbrAroG
ctctagaaataattttgtttaactttaagaaggagatatacatatgaattatcagaacgacgatttacgcatcaaagaaatcaaagagttacttcctcctgtcgcattgctggaaaaattccccgctactgaaaatgccgcgaatacggtcgcccatgcccgaaaagcgatccataagatcctgaaaggtaatgatgatcgcctgttggtggtgattggcccatgctcaattcatgatcctgtcgcggctaaagagtatgccactcgcttgctgacgctgcgtgaagagctgcaagatgagctggaaatcgtgatgcgcgtctattttgaaaagccgcgtactacggtgggctggaaagggctgattaacgatccgcatatggataacagcttccagatcaacgacggtctgcgtattgcccgcaaattgctgctcgatattaacgacagcggtctgccagcggcgggtgaattcctggatatgatcaccctacaatatctcgctgacctgatgagctggggcgcaattggcgcacgtaccaccgaatcgcaggtgcaccgcgaactggcgtctggtctttcttgtccggtaggtttcaaaaatggcactgatggtacgattaaagtggctatcgatgccattaatgccgccggtgcgccgcactgcttcctgtccgtaacgaaatgggggcattcggcgattgtgaataccagcggtaacggcgattgccatatcattctgcgcggcggtaaagagcctaactacagcgcgaagcacgttgctgaagtgaaagaagggctgaacaaagcaggcctgccagcgcaggtgatgatcgatttcagccatgctaactcgtcaaaacaattcaaaaagcagatggatgtttgtactgacgtttgccagcagattgccggtggcgaaaaggccattattggcgtgatggtggaaagccatctggtggaaggcaatcagagcctcgagagcggggaaccgctggcctacggtaagagcatcaccgatgcctgcattggctgggatgataccgatgctctgttacgtcaactggcgagtgcagtaaaagcgcgtcgcgggtaa

SEQ ID NO: 869 - DNA, 28 bp, Artificial Sequence
  Synthetic: BBa_J61133
tctagagaaagacccgagacactagatg

SEQ ID NO: 870 - DNA, 28 bp, Artificial Sequence
  Synthetic: BBa_J61134
tctagagaaagaccggaaatactagatg

SEQ ID NO: 871 - DNA, 28 bp, Artificial Sequence
  Synthetic: BBa_J61135
tctagagaaagaccggagacactagatg

SEQ ID NO: 872 - DNA, 6573 bp, Artificial Sequence
  Synthetic: TrpEDCBA
ctctagaaataattttgtttaactttaagaaggagatatacatatgcaaacacaaaaaccgactctcgaactgctaacctgcgaaggcgcttatcgcgacaacccgactgcgctttttcaccagttgtgtggggatcgtccggcaacgctgctgctggaatccgcagatatcgacagcaaagatgatttaaaaagcctgctgctggtagacagtgcgctgcgcattacagcattaagtgacactgtcacaatccaggcgctttccggcaatggagaagccctgttgacactactggataacgccttgcctgcgggtgtggaaaatgaacaatcaccaaactgccgcgtactgcgcttcccgcctgtcagtccactgctggatgaagacgcccgcttatgctccctttcggtttttgacgctttccgcttattacagaatctgttgaatgtaccgaaggaagaacgagaagcaatgttcttcggcggcctgttctcttatgaccttgtggcgggatttgaaaatttaccgcaactgtcagcggaaaatagctgccctgatttctgtttttatctcgctgaaacgctgatggtgattgaccatcagaaaaaaagcactcgtattcaggccagcctgtttgctccgaatgaagaagaaaaacaacgtctcactgctcgcctgaacgaactacgtcagcaactgaccgaagccgcgccgccgctgccggtggtttccgtgccgcatatgcgttgtgaatgtaaccagagcgatgaagagttcggtggtgtagtgcgtttgttgcaaaaagcgattcgcgccggagaaattttccaggtggtgccatctcgccgtttctctctgccctgcccgtcaccgctggcagcctattacgtgctgaaaaagagtaatcccagcccgtacatgttttttatgcaggataatgatttcaccctgtttggcgcgtcgccggaaagttcgctcaagtatgacgccaccagccgccagattgagatttacccgattgccggaacacgtccacgcggtcgtcgtgccgatggttcgctggacagagacctcgacagccgcatcgaactggagatgcgtaccgatcataaagagctttctgaacatctgatgctggtggatctcgcccgtaatgacctggcacgcatttgcacacccggcagccgctacgtcgccgatctcaccaaagttgaccgttactcttacgtgatgcacctagtctcccgcgttgttggtgagctgcgccacgatctcgacgccctgcacgcttaccgcgcctgtatgaatatggggacgttaagcggtgcaccgaaagtacgcgctatgcagttaattgccgaagcagaaggtcgtcgacgcggcagctacggcggcgcggtaggttattttaccgcgcatggcgatctcgacacctgcattgtgatccgctcggcgctggtggaaaacggtatcgccaccgtgcaagccggtgctggcgtagtccttgattctgttccgcagtcggaagccgacgaaactcgtaataaagcccgcgctgtactgcgcgctattgccaccgcgcatcatgcacaggagacgttctaatggctgacattctgctgctcgataatatcgactcttttacgtacaacctggcagatcagttgcgcagcaatggtcataacgtggtgatttaccgcaaccatattccggcgcagaccttaattgaacgcctggcgacgatgagcaatccggtgctgatgctttctcctggccccggtgtgccgagcgaagccggttgtatgccggaactcctcacccgcttgcgtggcaagctgccaattattggcatttgcctcggacatcaggcgattgtcgaagcttacgggggctatgtcggtcaggcgggcgaaattcttcacggtaaagcgtcgagcattgaacatgacggtcaggcgatgtttgccggattaacaaacccgctgccagtggcgcgttatcactcgctggttggcagtaacattccggccggtttaaccatcaacgcccattttaatggcatggtgatggcggtgcgtcacgatgcagatcgcgtttgtggattccagttccatccggaatccattcttactacccagggcgctcgcctgctggaacaaacgctggcctgggcgcagcagaaactagagccaaccaacacgctgcaaccgattctggaaaaactgtatcaggcacagacgcttagccaacaagaaagccaccagctgttttcagcggtggtacgtggcgagctgaagccggaacaactggcggcggcgctggtgagcatgaaaattcgcggtgaacacccgaacgagatcgccggggcagcaaccgcgctactggaaaacgccgcgccattcccgcgcccggattatctgtttgccgatatcgtcggtactggcggtgacggcagcaacagcatcaatatttctaccgccagtgcgtttgtcgccgcggcctgcgggctgaaagtggcgaaacacggcaaccgtagcgtctccagtaaatccggctcgtcggatctgctggcggcgttcggtattaatcttgatatgaacgccgataaatcgcgccaggcgctggatgagttaggcgtctgtttcctctttgcgccgaagtatcacaccggattccgccatgcgatgccggttcgccagcaactgaaaacccgcactctgttcaacgtgctgggaccattgattaacccggcgcatccgccgctggcgctaattggtgtttatagtccggaactggtgctgccgattgccgaaaccttgcgcgtgctggggtatcaacgcgcggcagtggtgcacagcggcgggatggatgaagtttcattacacgcgccgacaatcgttgccgaactacatgacggcgaaattaagagctatcaattgaccgctgaagattttggcctgacaccctaccaccaggagcaattggcaggcggaacaccggaagaaaaccgtgacattttaacacgcttgttacaaggtaaaggcgacgccgcccatgaagcagccgtcgcggcgaatgtcgccatgttaatgcgcctgcatggccatgaagatctgcaagccaatgcgcaaaccgttcttgaggtactgcgcagtggttccgcttacgacagagtcaccgcactggcggcacgagggtaaatgatgcaaaccgttttagcgaaaatcgtcgcagacaaggcgatttgggtagaaacccgcaaagagcagcaaccgctggccagttttcagaatgaggttcagccgagcacgcgacatttttatgatgcacttcagggcgcacgcacggcgtttattctggagtgtaaaaaagcgtcgccgtcaaaaggcgtgatccgtgatgatttcgatccggcacgcattgccgccatttataaacattacgcttcggcaatttcagtgctgactgatgagaaatattttcaggggagctttgatttcctccccatcgtcagccaaatcgccccgcagccgattttatgtaaagacttcattatcgatccttaccagatctatctggcgcgctattaccaggccgatgcctgcttattaatgctttcagtactggatgacgaacaatatcgccagcttgcagccgtcgcccacagtctggagatgggtgtgctgaccgaagtcagtaatgaagaggaactggagcgcgccattgcattgggggcaaaggtcgttggcatcaacaaccgcgatctgcgcgatttgtcgattgatctcaaccgtacccgcgagcttgcgccgaaactggggcacaacgtgacggtaatcagcgaatccggcatcaatacttacgctcaggtgcgcgagttaagccacttcgctaacggctttctgattggttcggcgttgatggcccatgacgatttgaacgccgccgtgcgtcgggtgttgctgggtgagaataaagtatgtggcctgacacgtgggcaagatgctaaagcagcttatgacgcgggcgcgatttacggtgggttgatttttgttgcgacatcaccgcgttgcgtcaacgttgaacaggcgcaggaagtgatggctgcagcaccgttgcagtatgttggcgtgttccgcaatcacgatattgccgatgtggcggacaaagctaaggtgttatcgctggcggcagtgcaactgcatggtaatgaagatcagctgtatatcgacaatctgcgtgaggctctgccagcacacgtcgccatctggaaggctttaagtgtcggtgaaactcttcccgcgcgcgattttcagcacatcgataaatatgtattcgacaacggtcagggcgggagcggacaacgtttcgactggtcactattaaatggtcaatcgcttggcaacgttctgctggcggggggcttaggcgcagataactgcgtggaagcggcacaaaccggctgcgccgggcttgattttaattctgctgtagagtcgcaaccgggtatcaaagacgcacgtcttttggcctcggttttccagacgctgcgcgcatattaaggaaaggaacaatgacaacattacttaacccctattttggtgagtttggcggcatgtacgtgccacaaatcctgatgcctgctctgcgccagctggaagaagcttttgtcagcgcgcaaaaagatcctgaatttcaggctcagttcaacgacctgctgaaaaactatgccgggcgtccaaccgcgctgaccaaatgccagaacattacagccgggacgaacaccacgctgtatctgaagcgcgaagatttgctgcacggcggcgcgcataaaactaaccaggtgctcggtcaggctttactggcgaagcggatgggtaaaactgaaattattgccgaaaccggtgccggtcagcatggcgtggcgtcggcccttgccagcgccctgctcggcctgaaatgccgaatttatatgggtgccaaagacgttgaacgccagtcgcccaacgttttccggatgcgcttaatgggtgcggaagtgatcccggtacatagcggttccgcgaccctgaaagatgcctgtaatgaggcgctacgcgactggtccggcagttatgaaaccgcgcactatatgctgggtaccgcagctggcccgcatccttacccgaccattgtgcgtgagtttcagcggatgattggcgaagaaacgaaagcgcagattctggaaagagaaggtcgcctgccggatgccgttatcgcctgtgttggcggtggttcgaatgccatcggtatgtttgcagatttcatcaacgaaaccgacgtcggcctgattggtgtggagcctggcggccacggtatcgaaactggcgagcacggcgcaccgttaaaacatggtcgcgtgggcatctatttcggtatgaaagcgccgatgatgcaaaccgaagacgggcaaattgaagagtcttactccatttctgccgggctggatttcccgtccgtcggcccgcaacatgcgtatctcaacagcactggacgcgctgattacgtgtctattaccgacgatgaagccctggaagcctttaaaacgctttgcctgcatgaagggatcatcccggcgctggaatcctcccacgccctggcccatgcgctgaaaatgatgcgcgaaaatccggaaaaagagcagctactggtggttaacctttccggtcgcggcgataaagacatcttcaccgttcacgatattttgaaagcacgaggggaaatctgatggaacgctacgaatctctgtttgcccagttgaaggagcgcaaagaaggcgcattcgttcctttcgtcaccctcggtgatccgggcattgagcagtcgttgaaaattatcgatacgctaattgaagccggtgctgacgcgctggagttaggcatccccttctccgacccactggcggatggcccgacgattcaaaacgccacactgcgtgcttttgcggcgggagtaaccccggcgcagtgctttgagatgctggcactcattcgccagaagcacccgaccattcccatcggccttttgatgtatgccaacctggtgtttaacaaaggcattgatgagttttatgccgagtgcgagaaagtcggcgtcgattcggtgctggttgccgatgtgcccgtggaagagtccgcgcccttccgccaggccgcgttgcgtcataatgtcgcacctatctttatttgcccgccgaatgccgacgatgatttgctgcgccagatagcctcttacggtcgtggttacacctatttgctgtcgcgagcgggcgtgaccggcgcagaaaaccgcgccgcgttacccctcaatcatctggttgcgaagctgaaagagtacaacgctgcgcctccattgcagggatttggtatttccgccccggatcaggtaaaagccgcgattgatgcaggagctgcgggcgcgatttctggttcggccatcgttaaaatcatcgagcaacatattaatgagccagagaaaatgctggcggcactgaaagcttttgtacaaccgatgaaagcggcgacgcgcagtta

SEQ ID NO: 873 - DNA, 28 bp, Artificial Sequence
  Synthetic: BBa_J61132
tctagagaaagacaggattaactagatg

SEQ ID NO: 874 - DNA, 28 bp, Artificial Sequence
  Synthetic: BBa_J61136
tctagagaaagagctgagcaactagatg

SEQ ID NO: 875 - DNA, 28 bp, Artificial Sequence
  Synthetic: BBa_J61137
tctagagaaagagtagatcaactagatg

SEQ ID NO: 876 - DNA, 28 bp, Artificial Sequence
  Synthetic: BBa_J61138
tctagagaaagatatgaataactagatg

SEQ ID NO: 877 - DNA, 28 bp, Artificial Sequence
  Synthetic: BBa_J61139
tctagagaaagattagagtcactagatg

SEQ ID NO: 878 - DNA, 6574 bp, Artificial Sequence
  Synthetic: fbrS40FTrpE-DCBA
ctctagaaataattttgtttaactttaagaaggagatatacatatgcaaacacaaaaaccgactctcgaactgctaacctgcgaaggcgcttatcgcgacaacccgactgcgctttttcaccagttgtgtggggatcgtccggcaacgctgctgctggaattcgcagatatcgacagcaaagatgatttaaaaagcctgctgctggtagacagtgcgctgcgcattacagcattaagtgacactgtcacaatccaggcgctttccggcaatggagaagccctgttgacactactggataacgccttgcctgcgggtgtggaaaatgaacaatcaccaaactgccgcgtactgcgcttcccgcctgtcagtccactgctggatgaagacgcccgcttatgctccctttcggtttttgacgctttccgcttattacagaatctgttgaatgtaccgaaggaagaacgagaagcaatgttcttcggcggcctgttctcttatgaccttgtggcgggatttgaaaatttaccgcaactgtcagcggaaaatagctgccctgatttctgtttttatctcgctgaaacgctgatggtgattgaccatcagaaaaaaagcactcgtattcaggccagcctgtttgctccgaatgaagaagaaaaacaacgtctcactgctcgcctgaacgaactacgtcagcaactgaccgaagccgcgccgccgctgccggtggtttccgtgccgcatatgcgttgtgaatgtaaccagagcgatgaagagttcggtggtgtagtgcgtttgttgcaaaaagcgattcgcgccggagaaattttccaggtggtgccatctcgccgtttctctctgccctgcccgtcaccgctggcagcctattacgtgctgaaaaagagtaatcccagcccgtacatgttttttatgcaggataatgatttcaccctgtttggcgcgtcgccggaaagttcgctcaagtatgacgccaccagccgccagattgagatttacccgattgccggaacacgtccacgcggtcgtcgtgccgatggttcgctggacagagacctcgacagccgcatcgaactggagatgcgtaccgatcataaagagctttctgaacatctgatgctggtggatctcgcccgtaatgacctggcacgcatttgcacacccggcagccgctacgtcgccgatctcaccaaagttgaccgttactcttacgtgatgcacctagtctcccgcgttgttggtgagctgcgccacgatctcgacgccctgcacgcttaccgcgcctgtatgaatatggggacgttaagcggtgcaccgaaagtacgcgctatgcagttaattgccgaagcagaaggtcgtcgacgcggcagctacggcggcgcggtaggttattttaccgcgcatggcgatctcgacacctgcattgtgatccgctcggcgctggtggaaaacggtatcgccaccgtgcaagccggtgctggcgtagtccttgattctgttccgcagtcggaagccgacgaaactcgtaataaagcccgcgctgtactgcgcgctattgccaccgcgcatcatgcacaggagacgttctaatggctgacattctgctgctcgataatatcgactcttttacgtacaacctggcagatcagttgcgcagcaatggtcataacgtggtgatttaccgcaaccatattccggcgcagaccttaattgaacgcctggcgacgatgagcaatccggtgctgatgctttctcctggccccggtgtgccgagcgaagccggttgtatgccggaactcctcacccgcttgcgtggcaagctgccaattattggcatttgcctcggacatcaggcgattgtcgaagcttacgggggctatgtcggtcaggcgggcgaaattcttcacggtaaagcgtcgagcattgaacatgacggtcaggcgatgtttgccggattaacaaacccgctgccagtggcgcgttatcactcgctggttggcagtaacattccggccggtttaaccatcaacgcccattttaatggcatggtgatggcggtgcgtcacgatgcagatcgcgtttgtggattccagttccatccggaatccattcttactacccagggcgctcgcctgctggaacaaacgctggcctgggcgcagcagaaactagagccaaccaacacgctgcaaccgattctggaaaaactgtatcaggcacagacgcttagccaacaagaaagccaccagctgttttcagcggtggtacgtggcgagctgaagccggaacaactggcggcggcgctggtgagcatgaaaattcgcggtgaacacccgaacgagatcgccggggcagcaaccgcgctactggaaaacgccgcgccattcccgcgcccggattatctgtttgccgatatcgtcggtactggcggtgacggcagcaacagcatcaatatttctaccgccagtgcgtttgtcgccgcggcctgcgggctgaaagtggcgaaacacggcaaccgtagcgtctccagtaaatccggctcgtcggatctgctggcggcgttcggtattaatcttgatatgaacgccgataaatcgcgccaggcgctggatgagttaggcgtctgtttcctctttgcgccgaagtatcacaccggattccgccatgcgatgccggttcgccagcaactgaaaacccgcactctgttcaacgtgctgggaccattgattaacccggcgcatccgccgctggcgctaattggtgtttatagtccggaactggtgctgccgattgccgaaaccttgcgcgtgctggggtatcaacgcgcggcagtggtgcacagcggcgggatggatgaagtttcattacacgcgccgacaatcgttgccgaactacatgacggcgaaattaagagctatcaattgaccgctgaagattttggcctgacaccctaccaccaggagcaattggcaggcggaacaccggaagaaaaccgtgacattttaacacgcttgttacaaggtaaaggcgacgccgcccatgaagcagccgtcgcggcgaatgtcgccatgttaatgcgcctgcatggccatgaagatctgcaagccaatgcgcaaaccgttcttgaggtactgcgcagtggttccgcttacgacagagtcaccgcactggcggcacgagggtaaatgatgcaaaccgttttagcgaaaatcgtcgcagacaaggcgatttgggtagaaacccgcaaagagcagcaaccgctggccagttttcagaatgaggttcagccgagcacgcgacatttttatgatgcacttcagggcgcacgcacggcgtttattctggagtgtaaaaaagcgtcgccgtcaaaaggcgtgatccgtgatgatttcgatccggcacgcattgccgccatttataaacattacgcttcggcaatttcagtgctgactgatgagaaatattttcaggggagctttgatttcctccccatcgtcagccaaatcgccccgcagccgattttatgtaaagacttcattatcgatccttaccagatctatctggcgcgctattaccaggccgatgcctgcttattaatgctttcagtactggatgacgaacaatatcgccagcttgcagccgtcgcccacagtctggagatgggtgtgctgaccgaagtcagtaatgaagaggaactggagcgcgccattgcattgggggcaaaggtcgttggcatcaacaaccgcgatctgcgcgatttgtcgattgatctcaaccgtacccgcgagcttgcgccgaaactggggcacaacgtgacggtaatcagcgaatccggcatcaatacttacgctcaggtgcgcgagttaagccacttcgctaacggctttctgattggttcggcgttgatggcccatgacgatttgaacgccgccgtgcgtcgggtgttgctgggtgagaataaagtatgtggcctgacacgtgggcaagatgctaaagcagcttatgacgcgggcgcgatttacggtgggttgatttttgttgcgacatcaccgcgttgcgtcaacgttgaacaggcgcaggaagtgatggctgcagcaccgttgcagtatgttggcgtgttccgcaatcacgatattgccgatgtggcggacaaagctaaggtgttatcgctggcggcagtgcaactgcatggtaatgaagatcagctgtatatcgacaatctgcgtgaggctctgccagcacacgtcgccatctggaaggctttaagtgtcggtgaaactcttcccgcgcgcgattttcagcacatcgataaatatgtattcgacaacggtcagggcgggagcggacaacgtttcgactggtcactattaaatggtcaatcgcttggcaacgttctgctggcggggggcttaggcgcagataactgcgtggaagcggcacaaaccggctgcgccgggcttgattttaattctgctgtagagtcgcaaccgggtatcaaagacgcacgtcttttggcctcggttttccagacgctgcgcgcatattaaggaaaggaacaatgacaacattacttaacccctattttggtgagtttggcggcatgtacgtgccacaaatcctgatgcctgctctgcgccagctggaagaagcttttgtcagcgcgcaaaaagatcctgaatttcaggctcagttcaacgacctgctgaaaaactatgccgggcgtccaaccgcgctgaccaaatgccagaacattacagccgggacgaacaccacgctgtatctgaagcgcgaagatttgctgcacggcggcgcgcataaaactaaccaggtgctcggtcaggctttactggcgaagcggatgggtaaaactgaaattattgccgaaaccggtgccggtcagcatggcgtggcgtcggcccttgccagcgccctgctcggcctgaaatgccgaatttatatgggtgccaaagacgttgaacgccagtcgcccaacgttttccggatgcgcttaatgggtgcggaagtgatcccggtacatagcggttccgcgaccctgaaagatgcctgtaatgaggcgctacgcgactggtccggcagttatgaaaccgcgcactatatgctgggtaccgcagctggcccgcatccttacccgaccattgtgcgtgagtttcagcggatgattggcgaagaaacgaaagcgcagattctggaaagagaaggtcgcctgccggatgccgttatcgcctgtgttggcggtggttcgaatgccatcggtatgtttgcagatttcatcaacgaaaccgacgtcggcctgattggtgtggagcctggcggccacggtatcgaaactggcgagcacggcgcaccgttaaaacatggtcgcgtgggcatctatttcggtatgaaagcgccgatgatgcaaaccgaagacgggcaaattgaagagtcttactccatttctgccgggctggatttcccgtccgtcggcccgcaacatgcgtatctcaacagcactggacgcgctgattacgtgtctattaccgacgatgaagccctggaagcctttaaaacgctttgcctgcatgaagggatcatcccggcgctggaatcctcccacgccctggcccatgcgctgaaaatgatgcgcgaaaatccggaaaaagagcagctactggtggttaacctttccggtcgcggcgataaagacatcttcaccgttcacgatattttgaaagcacgaggggaaatctgatggaacgctacgaatctctgtttgcccagttgaaggagcgcaaagaaggcgcattcgttcctttcgtcaccctcggtgatccgggcattgagcagtcgttgaaaattatcgatacgctaattgaagccggtgctgacgcgctggagttaggcatccccttctccgacccactggcggatggcccgacgattcaaaacgccacactgcgtgcttttgcggcgggagtaaccccggcgcagtgctttgagatgctggcactcattcgccagaagcacccgaccattcccatcggccttttgatgtatgccaacctggtgtttaacaaaggcattgatgagttttatgccgagtgcgagaaagtcggcgtcgattcggtgctggttgccgatgtgcccgtggaagagtccgcgcccttccgccaggccgcgttgcgtcataatgtcgcacctatctttatttgcccgccgaatgccgacgatgatttgctgcgccagatagcctcttacggtcgtggttacacctatttgctgtcgcgagcgggcgtgaccggcgcagaaaaccgcgccgcgttacccctcaatcatctggttgcgaagctgaaagagtacaacgctgcgcctccattgcagggatttggtatttccgccccggatcaggtaaaagccgcgattgatgcaggagctgcgggcgcgatttctggttcggccatcgttaaaatcatcgagcaacatattaatgagccagagaaaatgctggcggcactgaaagcttttgtacaaccgatgaaagcggcgacgcgcagttaa

SEQ ID NO: 879 - DNA, 1562 bp, Artificial Sequence
  Synthetic: fbrTrpE
atgcaaacacaaaaaccgactctcgaactgctaacctgcgaaggcgcttatcgcgacaacccgactgcgctttttcaccagttgtgtggggatcgtccggcaacgctgctgctggaattcgcagatatcgacagcaaagatgatttaaaaagcctgctgctggtagacagtgcgctgcgcattacagcattaagtgacactgtcacaatccaggcgctttccggcaatggagaagccctgttgacactactggataacgccttgcctgcgggtgtggaaaatgaacaatcaccaaactgccgcgtactgcgcttcccgcctgtcagtccactgctggatgaagacgcccgcttatgctccctttcggtttttgacgctttccgcttattacagaatctgttgaatgtaccgaaggaagaacgagaagcaatgttcttcggcggcctgttctcttatgaccttgtggcgggatttgaaaatttaccgcaactgtcagcggaaaatagctgccctgatttctgtttttatctcgctgaaacgctgatggtgattgaccatcagaaaaaaagcactcgtattcaggccagcctgtttgctccgaatgaagaagaaaaacaacgtctcactgctcgcctgaacgaactacgtcagcaactgaccgaagccgcgccgccgctgccggtggtttccgtgccgcatatgcgttgtgaatgtaaccagagcgatgaagagttcggtggtgtagtgcgtttgttgcaaaaagcgattcgcgccggagaaattttccaggtggtgccatctcgccgtttctctctgccctgcccgtcaccgctggcagcctattacgtgctgaaaaagagtaatcccagcccgtacatgttttttatgcaggataatgatttcaccctgtttggcgcgtcgccggaaagttcgctcaagtatgacgccaccagccgccagattgagatttacccgattgccggaacacgtccacgcggtcgtcgtgccgatggttcgctggacagagacctcgacagccgcatcgaactggagatgcgtaccgatcataaagagctttctgaacatctgatgctggtggatctcgcccgtaatgacctggcacgcatttgcacacccggcagccgctacgtcgccgatctcaccaaagttgaccgttactcttacgtgatgcacctagtctcccgcgttgttggtgagctgcgccacgatctcgacgccctgcacgcttaccgcgcctgtatgaatatggggacgttaagcggtgcaccgaaagtacgcgctatgcagttaattgccgaagcagaaggtcgtcgacgcggcagctacggcggcgcggtaggttattttaccgcgcatggcgatctcgacacctgcattgtgatccgctcggcgctggtggaaaacggtatcgccaccgtgcaagccggtgctggcgtagtccttgattctgttccgcagtcggaagccgacgaaactcgtaataaagcccgcgctgtactgcgcgctattgccaccgcgcatcatgcacaggagacgttcta

SEQ ID NO: 880 - DNA, 31 bp, Artificial Sequence
  Synthetic: BBa_B0029
tctagagttcacacaggaaacctactagatg

SEQ ID NO: 881 - DNA, 31 bp, Artificial Sequence
  Synthetic: BBa_B0030
tctagagattaaagaggagaaatactagatg

SEQ ID NO: 882 - DNA, 30 bp, Artificial Sequence
  Synthetic: BBa_B0031
tctagagtcacacaggaaacctactagatg

SEQ ID NO: 883 - DNA, 29 bp, Artificial Sequence
  Synthetic: BBa_B0032
tctagagtcacacaggaaagtactagatg

SEQ ID NO: 884 - DNA, 27 bp, Artificial Sequence
  Synthetic: BBa_B0033
tctagagtcacacaggactactagatg

SEQ ID NO: 885 - DNA, 28 bp, Artificial Sequence
  Synthetic: BBa_B0034
tctagagaaagaggagaaatactagatg

SEQ ID NO: 886 - DNA, 30 bp, Artificial Sequence
  Synthetic: BBa_B0035
tctagagattaaagaggagaatactagatg

SEQ ID NO: 887 - DNA, 28 bp, Artificial Sequence
  Synthetic: BBa_B0064
tctagagaaagaggggaaatactagatg

SEQ ID NO: 888 - DNA, 64 bp, Artificial Sequence; identical to SEQ ID NO: 744
  Synthetic: SYN23119 promoter

SEQ ID NO: 889 - DNA, 94 bp, Artificial Sequence
  Synthetic: SYN23119 promoter with RBS
ggaaaatttttttaaaaaaaaaacttgacagctagctcagtccttggtataatgctagcacgaagtgaattatataaaagtgggaggtgcccga

SEQ ID NO: 890 - DNA, 1225 bp, Artificial Sequence
  Synthetic: Pseudomonas fluorescens, codon optimized for expression in E. coli, driven by the SYN23119   Construct can be expressed from a plasmid, e.g., p15 or can be integrated into the chromosome, e.g., at the HA3/4 site
ggaaaatttttttaaaaaaaaaacttgacagctagctcagtccttggtataatgctagcacgaagtgaattatataaaagtgggaggtgcccgaatgacgacccgaaatgattgcctagcgttggatgcacaggacagtctggctccgctgcgccaacaatttgcgctgccggagggtgtgatatacctggatggcaattcgctgggcgcacgtccggtagctgcgctggctcgcgcgcaggctgtgatcgcagaagaatggggcaacgggttgatccgttcatggaactctgcgggctggcgtgatctgtctgaacgcctgggtaatcgcctggctaccctgattggtgcgcgcgatggggaagtagttgttactgataccacctcgattaatctgtttaaagtgctgtcagcggcgctgcgcgtgcaagctacccgtagcccggagcgccgtgttatcgtgactgagacctcgaatttcccgaccgacctgtatattgcggaagggttggcggatatgctgcaacaaggttacactctgcgtttggtggattcaccggaagagctgccacaggctatagatcaggacaccgcggtggtgatgctgacgcacgtaaattataaaaccggttatatgcacgacatgcaggctctgaccgcgttgagccacgagtgtggggctctggcgatttgggatctggcgcactctgctggcgctgtgccggtggacctgcaccaagcgggcgcggactatgcgattggctgcacgtacaaatacctgaatggcggcccgggttcgcaagcgtttgtttgggtttcgccgcaactgtgcgacctggtaccgcagccgctgtctggttggttcggccatagtcgccaattcgcgatggagccgcgctacgaaccttctaacggcattgctcgctatctgtgcggcactcagcctattactagcttggctatggtggagtgcggcctggatgtgtttgcgcagacggatatggcttcgctgcgccgtaaaagtctggcgctgactgatctgttcatcgagctggttgaacaacgctgcgctgcacacgaactgaccctggttactccacgtgaacacgcgaaacgcggctctcacgtgtcttttgaacaccccgagggttacgctgttattcaagctctgattgatcgtggcgtgatcggcgattaccgtgagccacgtattatgcgtttcggt

SEQ ID NO: 891 - DNA, 66 bp, Artificial Sequence; identical to SEQ ID NO: 740
  Synthetic: Lpp promoter from E. coli SEQ ID NO: 891

SEQ ID NO: 892 - DNA, 96 bp, Artificial Sequence
  Synthetic: Lpp promoter from E. coli SEQ ID NO: 892
ataagtgccttcccatcaaaaaaatattctcaacataaaaaactttgtgtaatacttgtaacgctagtgaattatataaaagtgggaggtgcccga

SEQ ID NO: 893 - DNA, 1347 bp, Artificial Sequence
  Synthetic: Pseudomonas fluorescens kynureninase driven by Lpp promoter from E. coli SEQ ID NO: 893  Construct can be expressed from a plasmid, e.g., p15 or can be integrated into the chromosome, e.g., at the HA3/4 site
ataagtgccttcccatcaaaaaaatattctcaacataaaaaactttgtgtaatacttgtaacgctagtgaattatataaaagtgggaggtgcccgaatgacgacccgaaatgattgcctagcgttggatgcacaggacagtctggctccgctgcgccaacaatttgcgctgccggagggtgtgatatacctggatggcaattcgctgggcgcacgtccggtagctgcgctggctcgcgcgcaggctgtgatcgcagaagaatggggcaacgggttgatccgttcatggaactctgcgggctggcgtgatctgtctgaacgcctgggtaatcgcctggctaccctgattggtgcgcgcgatggggaagtagttgttactgataccacctcgattaatctgtttaaagtgctgtcagcggcgctgcgcgtgcaagctacccgtagcccggagcgccgtgttatcgtgactgagacctcgaatttcccgaccgacctgtatattgcggaagggttggcggatatgctgcaacaaggttacactctgcgtttggtggattcaccggaagagctgccacaggctatagatcaggacaccgcggtggtgatgctgacgcacgtaaattataaaaccggttatatgcacgacatgcaggctctgaccgcgttgagccacgagtgtggggctctggcgatttgggatctggcgcactctgctggcgctgtgccggtggacctgcaccaagcgggcgcggactatgcgattggctgcacgtacaaatacctgaatggcggcccgggttcgcaagcgtttgtttgggtttcgccgcaactgtgcgacctggtaccgcagccgctgtctggttggttcggccatagtcgccaattcgcgatggagccgcgctacgaaccttctaacggcattgctcgctatctgtgcggcactcagcctattactagcttggctatggtggagtgcggcctggatgtgtttgcgcagacggatatggcttcgctgcgccgtaaaagtctggcgctgactgatctgttcatcgagctggttgaacaacgctgcgctgcacacgaactgaccctggttactccacgtgaacacgcgaaacgcggctctcacgtgtcttttgaacaccccgagggttacgctgttattcaagctctgattgatcgtggcgtgatcggcgattaccgtgagccacgtattatgcgtttcggtttcactcctctgtatactacttttacggaagtttgggatgcagtacaaatcctgggcgaaatcctggatcgtaagacttgggcgcaggctcagtttcaggtgcgccactctgttacttaa

SEQ ID NO: 894 - DNA, 138 bp, Artificial Sequence
  Synthetic: fliC-FliC20
tgacggcgattgagccgacgggtggaaacccaaaacgtaatcaacgtgggtactccttaaattgggttcgaatggaccatggcacaagtcattaataccaacagcctctcgctgatcactcaaaataatatcaacaag

SEQ ID NO: 895 - DNA, 70 bp, Artificial Sequence
  Synthetic: fliC-RBS
tgacggcgattgagccgacgggtggaaacccaaaacgtaatcaactacgaacacttacaggaggtaccca

SEQ ID NO: 896 - DNA, 70 bp, Artificial Sequence
  Synthetic: fliC-RBS
tgacggcgattgagccgacgggtggaaacccaaaacgtaatcaacaagtataaactctgggaggttccta

SEQ ID NO: 897 - DNA, 70 bp, Artificial Sequence
  Synthetic: fliC-RBS
tgacggcgattgagccgacgggtggaaacccaaaacgtaatcaactcaaatcccttaataaggaggtaaa

SEQ ID NO: 898 - DNA, 106 bp, Artificial Sequence
  Synthetic: RBS-phoA
ctctagaaataattttgtttaactttaagaaggagatatacatatgaaacaaagcactattgcactggcactcttaccgttactgtttacccctgtgacaaaagcg

SEQ ID NO: 899 - DNA, 63 bp, Artificial Sequence
  Synthetic: phoA
atgaaacaaagcactattgcactggcactcttaccgttactgtttacccctgtgacaaaagcg

SEQ ID NO: 900 - DNA, 109 bp, Artificial Sequence
  Synthetic: RBS-ompF
ctctagaaataattttgtttaactttaagaaggagatatacatatgatgaagcgcaatattctggcagtgatcgtccctgctctgttagtagcaggtactgcaaacgct

SEQ ID NO: 901 - DNA, 66 bp, Artificial Sequence
  Synthetic: ompF
atgatgaagcgcaatattctggcagtgatcgtccctgctctgttagtagcaggtactgcaaacgct

SEQ ID NO: 902 - DNA, 88 bp, Artificial Sequence
  Synthetic: RBS-cvaC
ctctagaaataattttgtttaactttaagaaggagatatacatatgagaactctgactctaaatgaattagattctgtttctggtggt

SEQ ID NO: 903 - DNA, 45 bp, Artificial Sequence
  Synthetic: cvaC
atgagaactctgactctaaatgaattagattctgtttctggtggt

SEQ ID NO: 904 - DNA, 88 bp, Artificial Sequence
  Synthetic: RBS-phoA (Optimized)
gacgccagagagttaagggggttaaatgaaacaatcgaccatcgcattggcgctgcttcctctattgttcacaccggtgacaaaggca

SEQ ID NO: 905 - DNA, 63 bp, Artificial Sequence
  Synthetic: Optimized phoA
atgaaacaatcgaccatcgcattggcgctgcttcctctattgttcacaccggtgacaaaggca

SEQ ID NO: 906 - DNA, 160 bp, Artificial Sequence
  Synthetic: RBS-TorA
ctctagaaataattttgtttaactttaagaaggagatatacatatgaacaataacgatctctttcaggcatcacgtcggcgttttctggcacaactcggcggcttaaccgtcgccgggatgctggggccgtcattgttaacgccgcgacgtgcgactgcg

SEQ ID NO: 907 - DNA, 117 bp, Artificial Sequence
  Synthetic: TorA
atgaacaataacgatctctttcaggcatcacgtcggcgttttctggcacaactcggcggcttaaccgtcgccgggatgctggggccgtcattgttaacgccgcgacgtgcgactgcg

SEQ ID NO: 908 - DNA, 148 bp, Artificial Sequence
  Synthetic: RBS-TorA alternate
cccacattcgaggtactaaatgaacaataacgatctctttcaggcatcacgtcggcgttttctggcacaactcggcggcttaaccgtcgccgggatgctggggacgtcattgttaacgccgcgccgtgcgactgcggcgcaagcggcg

SEQ ID NO: 909 - DNA, 129 bp, Artificial Sequence
  Synthetic: TorA (alternate)
atgaacaataacgatctctttcaggcatcacgtcggcgttttctggcacaactcggcggcttaaccgtcgccgggatgctggggacgtcattgttaacgccgcgccgtgcgactgcggcgcaagcggcg

SEQ ID NO: 910 - DNA, 130 bp, Artificial Sequence
  Synthetic: RBS-fdnG
accctattacacacctaaggaggccaaatacatggacgtcagtcgcagacaattttttaaaatctgcgcgggcggtatggcgggaacaacagtagcagcattgggctttgccccgaagcaagcactggct

SEQ ID NO: 911 - DNA, 99 bp, Artificial Sequence
  Synthetic: fdnG
atggacgtcagtcgcagacaattttttaaaatctgcgcgggcggtatggcgggaacaacagtagcagcattgggctttgccccgaagcaagcactggct

SEQ ID NO: 912 - DNA, 168 bp, Artificial Sequence
  Synthetic: RBS-dmsA
tacgcaaaaaacataatttaagagaggataaacatgaaaacgaaaatccctgatgcggtattggctgctgaggtgagtcgccgtggtttggtaaaaacgacagcgatcggcggcctggcaatggccagcagcgcattaacattaccttttagtcggattgcgcacgct

SEQ ID NO: 913 - DNA, 135 bp, Artificial Sequence
  Synthetic: dmsA
atgaaaacgaaaatccctgatgcggtattggctgctgaggtgagtcgccgtggtttggtaaaaacgacagcgatcggcggcctggcaatggccagcagcgcattaacattaccttttagtcggattgcgcacgct

SEQ ID NO: 914 - DNA, 712 bp, Artificial Sequence
  Synthetic: TetR/TetA Promoter
gaattcgttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaa

SEQ ID NO: 915 - DNA, 104 bp, Artificial Sequence; identical to SEQ ID NO: 801
  Synthetic: fliC Promoter

SEQ ID NO: 916 - DNA, 162 bp, Artificial Sequence
  Synthetic: FnrS Promoter
ggtaccagttgttcttattggtggtgttgctttatggttgcatcgtagtaaatggttgtaacaaaagcaatttttccggctgtctgtatacaaaaacgccgcaaagtttgagcgaagtcaataaactctctacccattcagggcaatatctctcttggatcc

SEQ ID NO: 917 - DNA, 358 bp, Artificial Sequence
  Synthetic: DOM Construct Terminator
cacatttccccgaaaagtgccgatggccccccgatggtagtgtggcccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtggccagtgccaagcttgcatgcagattgcagcattacacgtcttgagcgattgtgtaggctggagctgcttc

SEQ ID NO: 918 - DNA, 48 bp, Artificial Sequence
  Synthetic: FRT Site
gaagttcctatactttctagagaataggaacttcggaataggaacttc

SEQ ID NO: 919 - DNA, 1345 bp, Artificial Sequence
  Synthetic: Kanamycin Resistance Cassette (for integration in between FRT sites)
aagatcccctcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccagcttcaaaagcgctct

SEQ ID NO: 920 - protein, 219 aa, Artificial Sequence
  Synthetic: human IL-12a construct with a N terminal OmpF secretion tag (sec-dependent secretion system)
MMKRNILAVIVPALLVAGTANARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 921 - protein, 218 aa, Artificial Sequence
  Synthetic: human IL-12a construct with a N terminal PhoA secretion
MKQSTIALALLPLLFTPVTKARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 922 - protein, 236 aa, Artificial Sequence
  Synthetic: human IL-12a construct with a N terminal TorA secretion tag (sec-dependent secretion system)
MNNNDLFQASRRRFLAQLGGLTVAGMLGPSLLTPRRATARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 923 - protein, 328 aa, Artificial Sequence
  Synthetic: human IL-12b construct with a N terminal OmpF secretion tag (sec-dependent secretion system)
MMKRNILAVIVPALLVAGTANAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 924 - protein, 327 aa, Artificial Sequence
  Synthetic: human IL-12b construct with a N terminal PhoA secretion tag
MKQSTIALALLPLLFTPVTKAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 925 - protein, 345 aa, Artificial Sequence
  Synthetic: human IL-12 construct with a N terminal TorA secretion tag (sec-dependent secretion system)
MNNNDLFQASRRRFLAQLGGLTVAGMLGPSLLTPRRATAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 926 - protein, 219 aa, Artificial Sequence; identical to SEQ ID NO: 920
  Synthetic: murine IL-12a construct with a N terminal OmpF secretion tag (sec-dependent secretion system)

SEQ ID NO: 927 - protein, 218 aa, Artificial Sequence; identical to SEQ ID NO: 921
  Synthetic: murine IL-12a construct with a N terminal PhoA secretion tag

SEQ ID NO: 928 - protein, 236 aa, Artificial Sequence; identical to SEQ ID NO: 922
  Synthetic: murine IL-12a construct with a N terminal TorA secretion tag (sec-dependent secretion system)

SEQ ID NO: 929 - protein, 335 aa, Artificial Sequence
  Synthetic: murine IL-12b construct with a N terminal OmpF secretion tag (sec-dependent secretion system)
MMKRNILAVIVPALLVAGTANAMWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRS

SEQ ID NO: 930 - protein, 334 aa, Artificial Sequence
  Synthetic: murine IL-12b construct with a N terminal PhoA secretion tag
MKQSTIALALLPLLFTPVTKAMWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRS

SEQ ID NO: 931 - protein, 352 aa, Artificial Sequence
  Synthetic: murine IL-12b construct with a N terminal TorA secretion tag (sec-dependent secretion system)
MNNNDLFQASRRRFLAQLGGLTVAGMLGPSLLTPRRATAMWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRS

SEQ ID NO: 932 - protein, 149 aa, Artificial Sequence
  Synthetic: human GMCSF construct with a N terminal OmpF secretion tag (sec-dependent secretion system)
MMKRNILAVIVPALLVAGTANAAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 933 - protein, 148 aa, Artificial Sequence
  Synthetic: human GMCSF construct with a N terminal PhoA secretion tag
MKQSTIALALLPLLFTPVTKAAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 934 - protein, 166 aa, Artificial Sequence
  Synthetic: human GMCSF construct with a N terminal TorA secretion tag (sec-dependent secretion system)
MNNNDLFQASRRRFLAQLGGLTVAGMLGPSLLTPRRATAAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 935 - protein, 136 aa, Artificial Sequence
  Synthetic: human Il-15 construct with a N terminal OmpF secretion tag (sec-dependent secretion system)
MMKRNILAVIVPALLVAGTANANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 936 - protein, 135 aa, Artificial Sequence
  Synthetic: human Il-15 construct with a N terminal PhoA secretion tag
MKQSTIALALLPLLFTPVTKANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 937 - protein, 153 aa, Artificial Sequence
  Synthetic: human Il-15 construct with a N terminal TorA secretion tag (sec-dependent secretion system)
MNNNDLFQASRRRFLAQLGGLTVAGMLGPSLLTPRRATANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 938 - protein, 199 aa, Artificial Sequence
  Synthetic: human TNFa construct with a N terminal OmpF secretion tag (sec-dependent secretion system)
MMKRNILAVIVPALLVAGTANAGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 939 - protein, 198 aa, Artificial Sequence
  Synthetic: human TNFa construct with a N terminal PhoA secretion tag
MKQSTIALALLPLLFTPVTKAGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 940 - protein, 216 aa, Artificial Sequence
  Synthetic: human TNFa construct with a N terminal TorA secretion tag (sec-dependent secretion system)
MNNNDLFQASRRRFLAQLGGLTVAGMLGPSLLTPRRATAGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 941 - protein, 160 aa, Artificial Sequence
  Synthetic: human IFNg construct with a N terminal OmpF secretion tag (sec-dependent secretion system)
MMKRNILAVIVPALLVAGTANAQDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRG

SEQ ID NO: 942 - protein, 159 aa, Artificial Sequence
  Synthetic: human IFNg construct with a N terminal PhoA secretion tag
MKQSTIALALLPLLFTPVTKAQDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRG

SEQ ID NO: 943 - protein, 177 aa, Artificial Sequence
  Synthetic: human IFNg construct with a N terminal TorA secretion tag (sec-dependent secretion system)
MNNNDLFQASRRRFLAQLGGLTVAGMLGPSLLTPRRATAQDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRG

SEQ ID NO: 944-952 - skipped (9 entries)

SEQ ID NO: 953 - DNA, 657 bp, Artificial Sequence
  Synthetic: human IL-12a construct with a N terminal PhoA secretion tag
atgaaacagagcacaattgctctggccttgttgccattactgtttacccctgttactaaggctaggaacctgcctgtggcaacaccagaccctgggatgttcccttgcttacatcattcccagaacctgttgcgtgcggtgtctaacatgctgcagaaagccaggcagacgctggaattctacccatgcacttccgaagagatagatcatgaagacattacgaaagacaaaacctcaacggttgaagcatgcttacctctggaattgactaagaatgaatcgtgcttaaactcaagagagaccagtttcatcactaatggctcttgcttagcgtcgcgcaagaccagcttcatgatggcgctctgcctaagtagcatctacgaggacctcaaaatgtaccaagttgaatttaaaactatgaatgccaaacttctaatggacccaaaaagacagatatttttagatcagaatatgcttgcggttattgacgaactcatgcaggcattgaattttaattccgagacggtgccacaaaaaagttctttggaggagccggacttttacaagacaaaaatcaagctgtgcatacttcttcacgcattcagaatacgggccgttacgatcgatcgcgtcatgtcgtatcttaatgcgagctga

SEQ ID NO: 954 - DNA, 987 bp, Artificial Sequence
  Synthetic: human IL-12b construct with a N terminal PhoA secretion tag
atgaagcagagcacgatcgcattggcgttgctaccgctgttgtttaccccggtcacaaaagccatctgggaactgaaaaaagatgtttatgtagttgaactggattggtacccggatgcacccggtgagatggtggttttgacctgcgacacgccggaagaagatggcataacgtggaccctggatcaaagctctgaagttctgggttcaggtaagacattgacgatccaagtaaaagaatttggcgacgcaggtcagtacacctgccacaaaggtggcgaagttctgtcgcactcactcctgctcctgcacaaaaaagaggatggcatctggagtactgatatcctaaaggatcaaaaagaacctaaaaacaaaacgttcttgcgctgtgaagcgaagaactatagtggtcgctttacgtgctggtggttgactaccatttccaccgatttgaccttttctgttaagagttcgcgcggctcgtcagatccgcagggcgttacttgcggtgcggcgacgctgtcagctgagagagttcgtggggacaacaaagagtacgaatatagtgtagaatgtcaagaggattcggcgtgcccggcagcagaggagtctctccccattgaagttatggtggacgcagtgcataaactgaaatatgagaattacacatcaagcttttttattcgcgatatcatcaaaccggatcctccaaaaaatctgcaactaaagcccctgaaaaattcgcgccaagttgaggtgagctgggaatatccggatacttggtcgacaccgcattcttatttctcactgaccttctgcgttcaggttcaaggtaaatcaaaacgagaaaaaaaggatcgcgtctttaccgacaaaacgtctgctactgtaatctgccgcaagaatgcgtcaatttctgtacgtgcgcaagatcgctactactctagtagttggtctgaatgggcttcagtgccatgctcctgatga

SEQ ID NO: 955 - DNA, 657 bp, Artificial Sequence
  Synthetic: murine IL-12a construct with a N terminal PhoA secretion tag
atgaaacagagtacgatagccctagccctgttgccgctcctgttcacccccgttactaaagcacgtaaccttccggtggccacgccagatccgggcatgttcccgtgcttacaccattcccagaatctgctgcgcgctgtgagtaatatgctgcagaaggcgagacaaactttggaattttacccgtgcacttcggaggagattgaccatgaggatatcacaaaagacaaaaccagtacagtggaagcctgcctgccccttgaactgactaaaaatgagagttgtttaaattcacgcgaaaccagcttcattactaacggaagctgcttagcatcgcggaaaaccagttttatgatggccctttgcctttcatctatttacgaggaccttaaaatgtatcaagttgaatttaagactatgaacgcgaaactgctaatggatcccaagcgacaaatctttcttgatcaaaatatgttggctgttattgatgaactgatgcaagccctgaattttaactcagaaaccgtacctcagaaatcgagtttagaagaacccgatttctacaaaactaaaatcaagttgtgtatccttttacatgccttccggattcgggccgtcactattgatcgcgtgatgtcgtacttgaatgcctcctaa

SEQ ID NO: 956 - DNA, 1005 bp, Artificial Sequence
  Synthetic: murine IL-12b construct with a N terminal PhoA secretion tag
atgaaacagagcacgatcgcacttgcccttttgccgctgttatttaccccagtgacgaaagccatgtgggaattggaaaaagacgtgtatgttgttgaagttgactggactccggacgcgcctggtgaaactgttaatctgacttgtgatacaccggaggaagatgatataacttggactagcgatcaacgacacggcgtaatcggctctggtaagactttgaccattactgtgaaggaattcttggatgcggggcaatatacgtgtcataaaggcggcgagacgctgtcacactctcacctgttgttacataaaaaagagaatggtatatggtctacggagatcttgaaaaactttaaaaacaaaacttttttgaagtgtgaggctccaaactattctggtcgctttacctgtagttggttggtgcaacgtaacatggatctcaaatttaacataaagtcgtcttcgtcttctcccgatagccgagcggttacctgtggcatggctagtttgtcggcggagaaggtgaccttggatcaacgtgattatgaaaaatatagcgtttcgtgccaagaggacgttacgtgccctaccgctgaagagactttgccgattgaattggcactggaagcacgacaacaaaataaatacgagaattactcaactagtttcttcatccgagatatcataaaaccggaccccccgaagaatctgcaaatgaaaccgcttaaaaattcacaggtagaggtttcgtgggagtacccggatagttggtctacgcctcattcgtattttagcctgaaatttttcgttcgaatacagcgaaaaaaagagaagatgaaagaaactgaagaagggtgtaaccaaaaaggtgcatttctggtggagaaaactagcaccgaggttcaatgcaaaggcggtaacgtgtgcgtacaagctcaagaccgttattataacagtagctgttctaaatgggcttgcgtgccctgccgcgtgagatcatga

SEQ ID NO: 957 - DNA, 408 bp, Artificial Sequence
  Synthetic: human Il-15 construct with a N terminal PhoA secretion tag
atgaagcaatctacgatcgcactagcgttactgccgttattgtttactcctgtgactaaggctaattgggttaatgttatatctgatttgaaaaaaatagaggatctgattcaatcaatgcacatagatgcgactctgtatactgagagcgatgtgcacccgagttgcaaagttactgctatgaaatgttttctgctggagctgcaagttatctctctggagagtggtgatgcgtctattcacgatactgttgagaatctgattattctggctaataactcgctgtcaagtaatgggaatgttacggaatctggctgtaaggagtgtgaagaattagaagaaaaaaatattaaagagtttctgcagagttttgtgcacattgttcagatgtttatcaatactagctga

SEQ ID NO: 958 - DNA, 447 bp, Artificial Sequence
  Synthetic: human GMCSF construct with a N terminal PhoA secretion tag
atgaagcaatctacgatcgcgttggccttactgcccctgttattcacacccgtgaccaaagcggcaccggcccgcagcccatcaccgtcaactcaaccttgggaacatgtaaatgctattcaagaagctcgccgcctgttgaatttgagtcgcgatactgcagcagagatgaatgagactgtagaggtgatttcagaaatgtttgacctgcaggagccgacttgtttgcaaactcgcctggagctgtacaaacaaggcctgcgtggctcgctgactaaactgaaaggtcctctgacgatgatggcttctcattataaacaacactgcccgcctactccggagacgtcttgcgcgacccagataattacttttgaatcttttaaagagaatctgaaagactttctgctggttatcccgtttgattgttgggaaccggttcaagaataa

SEQ ID NO: 959 - DNA, 597 bp, Artificial Sequence
  Synthetic: human TNFa construct with a N terminal PhoA secretion tag
atgaaacaatcaacgatcgctctggctctgcttccgctgctctttactccagttactaaagcgggtccgcagagggaagaattcccgcgcgatttgagcctgatttcacctcttgctcaggctgtccgctcctcttcgcgtaccccctcggataaacctgtcgcgcacgtggttgcgaacccgcaagcggaagggcagctgcaatggttaaaccgccgggctaatgcactgctggctaatggagttgagttacgcgacaaccaacttgtcgttccttcggaagggctgtatctgatctattcacaggttctctttaaagggcagggttgcccatcaacccacgtgctcctgacacacacgatcagtcgtatcgcggtatcctatcagacgaaagttaacctcctgtcagcgattaaatcgccgtgtcagagagaaactccagagggtgcggaagctaaaccgtggtatgaacctatttatcttggtggagttttccagttggaaaaaggtgatagactgtcggcagagatcaatcgccctgattacctggatttcgctgagtcgggtcaggtttatttcggaattattgcactgtga

SEQ ID NO: 960 - DNA, 480 bp, Artificial Sequence
  Synthetic: human IFNg construct with a N terminal PhoA secretion tag
atgaagcaatctacgatagcactggcgttgctgccgctgctgttcaccccggttaccaaggcgcaggatccttacgttaaagaagcagagaatctgaaaaaatactttaatgcaggccacagcgatgtggcagataatggcacgttattcctgggcattctgaaaaattggaaagaagaatctgaccggaagatcatgcaatctcagatcgtatcattttatttcaagttgtttaaaaacttcaaggatgaccagtcgattcaaaaatcagtggaaacgatcaaagaagatatgaacgttaagttcttcaactcaaataaaaaaaaacgcgatgatttcgaaaaactgactaattattcggtaactgatttgaatgttcagcgcaaggcgattcatgaattgattcaggttatggcagaactgtcgccagcggcaaaaacgggtaaacgaaaacgttctcagatgttgtttcgtggttga

SEQ ID NO: 961-964 - skipped (4 entries)

SEQ ID NO: 965 - DNA, 2531 bp, Artificial Sequence
  Synthetic: Ptet.phoA-hIL12b-phoA-hIL12a
ccaggatacatagattaccacaactccgagcccttccaccttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaaataagtcataaatagggagtccaaaatgaagcagagcacgatcgcattggcgttgctaccgctgttgtttaccccggtcacaaaagccatctgggaactgaaaaaagatgtttatgtagttgaactggattggtacccggatgcacccggtgagatggtggttttgacctgcgacacgccggaagaagatggcataacgtggaccctggatcaaagctctgaagttctgggttcaggtaagacattgacgatccaagtaaaagaatttggcgacgcaggtcagtacacctgccacaaaggtggcgaagttctgtcgcactcactcctgctcctgcacaaaaaagaggatggcatctggagtactgatatcctaaaggatcaaaaagaacctaaaaacaaaacgttcttgcgctgtgaagcgaagaactatagtggtcgctttacgtgctggtggttgactaccatttccaccgatttgaccttttctgttaagagttcgcgcggctcgtcagatccgcagggcgttacttgcggtgcggcgacgctgtcagctgagagagttcgtggggacaacaaagagtacgaatatagtgtagaatgtcaagaggattcggcgtgcccggcagcagaggagtctctccccattgaagttatggtggacgcagtgcataaactgaaatatgagaattacacatcaagcttttttattcgcgatatcatcaaaccggatcctccaaaaaatctgcaactaaagcccctgaaaaattcgcgccaagttgaggtgagctgggaatatccggatacttggtcgacaccgcattcttatttctcactgaccttctgcgttcaggttcaaggtaaatcaaaacgagaaaaaaaggatcgcgtctttaccgacaaaacgtctgctactgtaatctgccgcaagaatgcgtcaatttctgtacgtgcgcaagatcgctactactctagtagttggtctgaatgggcttcagtgccatgctcctgatgagaaaccctacggaggaggttaatttatgaaacagagcacaattgctctggccttgttgccattactgtttacccctgttactaaggctaggaacctgcctgtggcaacaccagaccctgggatgttcccttgcttacatcattcccagaacctgttgcgtgcggtgtctaacatgctgcagaaagccaggcagacgctggaattctacccatgcacttccgaagagatagatcatgaagacattacgaaagacaaaacctcaacggttgaagcatgcttacctctggaattgactaagaatgaatcgtgcttaaactcaagagagaccagtttcatcactaatggctcttgcttagcgtcgcgcaagaccagcttcatgatggcgctctgcctaagtagcatctacgaggacctcaaaatgtaccaagttgaatttaaaactatgaatgccaaacttctaatggacccaaaaagacagatatttttagatcagaatatgcttgcggttattgacgaactcatgcaggcattgaattttaattccgagacggtgccacaaaaaagttctttggaggagccggacttttacaagacaaaaatcaagctgtgcatacttcttcacgcattcagaatacgggccgttacgatcgatcgcgtcatgtcgtatcttaatgcgagctgaaaataaaacgaaaggctcagtcgaaagactgggcctttcgttttatctgttggttccttatcatctggcgaatcggacccacaagagcactg

SEQ ID NO: 966 - DNA, 2549 bp, Artificial Sequence
  Synthetic: Ptet.phoA-mIL12b-phoA-mIL12a
ccaggatacatagattaccacaactccgagcccttccaccttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaatgttacacatctaaggagaaacattatgaaacagagcacgatcgcacttgcccttttgccgctgttatttaccccagtgacgaaagccatgtgggaattggaaaaagacgtgtatgttgttgaagttgactggactccggacgcgcctggtgaaactgttaatctgacttgtgatacaccggaggaagatgatataacttggactagcgatcaacgacacggcgtaatcggctctggtaagactttgaccattactgtgaaggaattcttggatgcggggcaatatacgtgtcataaaggcggcgagacgctgtcacactctcacctgttgttacataaaaaagagaatggtatatggtctacggagatcttgaaaaactttaaaaacaaaacttttttgaagtgtgaggctccaaactattctggtcgctttacctgtagttggttggtgcaacgtaacatggatctcaaatttaacataaagtcgtcttcgtcttctcccgatagccgagcggttacctgtggcatggctagtttgtcggcggagaaggtgaccttggatcaacgtgattatgaaaaatatagcgtttcgtgccaagaggacgttacgtgccctaccgctgaagagactttgccgattgaattggcactggaagcacgacaacaaaataaatacgagaattactcaactagtttcttcatccgagatatcataaaaccggaccccccgaagaatctgcaaatgaaaccgcttaaaaattcacaggtagaggtttcgtgggagtacccggatagttggtctacgcctcattcgtattttagcctgaaatttttcgttcgaatacagcgaaaaaaagagaagatgaaagaaactgaagaagggtgtaaccaaaaaggtgcatttctggtggagaaaactagcaccgaggttcaatgcaaaggcggtaacgtgtgcgtacaagctcaagaccgttattataacagtagctgttctaaatgggcttgcgtgccctgccgcgtgagatcatgagaagaagattattgaagaggtccgcatgaaacagagtacgatagccctagccctgttgccgctcctgttcacccccgttactaaagcacgtaaccttccggtggccacgccagatccgggcatgttcccgtgcttacaccattcccagaatctgctgcgcgctgtgagtaatatgctgcagaaggcgagacaaactttggaattttacccgtgcacttcggaggagattgaccatgaggatatcacaaaagacaaaaccagtacagtggaagcctgcctgccccttgaactgactaaaaatgagagttgtttaaattcacgcgaaaccagcttcattactaacggaagctgcttagcatcgcggaaaaccagttttatgatggccctttgcctttcatctatttacgaggaccttaaaatgtatcaagttgaatttaagactatgaacgcgaaactgctaatggatcccaagcgacaaatctttcttgatcaaaatatgttggctgttattgatgaactgatgcaagccctgaattttaactcagaaaccgtacctcagaaatcgagtttagaagaacccgatttctacaaaactaaaatcaagttgtgtatccttttacatgccttccggattcgggccgtcactattgatcgcgtgatgtcgtacttgaatgcctcctaaaaataaaacgaaaggctcagtcgaaagactgggcctttcgttttatctgttggttccttatcatctggcgaatcggacccacaagagcactg

SEQ ID NO: 967 - DNA, 1270 bp, Artificial Sequence
  Synthetic: Ptet.phoA-IL15
ccaggatacatagattaccacaactccgagcccttccaccttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaagatcaactcaagataaggaggatccatgaagcaatctacgatcgcactagcgttactgccgttattgtttactcctgtgactaaggctaattgggttaatgttatatctgatttgaaaaaaatagaggatctgattcaatcaatgcacatagatgcgactctgtatactgagagcgatgtgcacccgagttgcaaagttactgctatgaaatgttttctgctggagctgcaagttatctctctggagagtggtgatgcgtctattcacgatactgttgagaatctgattattctggctaataactcgctgtcaagtaatgggaatgttacggaatctggctgtaaggagtgtgaagaattagaagaaaaaaatattaaagagtttctgcagagttttgtgcacattgttcagatgtttatcaatactagctgaaaataaaacgaaaggctcagtcgaaagactgggcctttcgttttatctgttggttccttatcatctggcgaatcggacccacaagagcactg

SEQ ID NO: 968 - DNA, 1309 bp, Artificial Sequence
  Synthetic: Ptet.phoA-GMCSF
ccaggatacatagattaccacaactccgagcccttccaccttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaagaaagcaacaacatagggggaaagaatgaagcaatctacgatcgcgttggccttactgcccctgttattcacacccgtgaccaaagcggcaccggcccgcagcccatcaccgtcaactcaaccttgggaacatgtaaatgctattcaagaagctcgccgcctgttgaatttgagtcgcgatactgcagcagagatgaatgagactgtagaggtgatttcagaaatgtttgacctgcaggagccgacttgtttgcaaactcgcctggagctgtacaaacaaggcctgcgtggctcgctgactaaactgaaaggtcctctgacgatgatggcttctcattataaacaacactgcccgcctactccggagacgtcttgcgcgacccagataattacttttgaatcttttaaagagaatctgaaagactttctgctggttatcccgtttgattgttgggaaccggttcaagaataaaaataaaacgaaaggctcagtcgaaagactgggcctttcgttttatctgttggttccttatcatctggcgaatcggacccacaagagcactg

SEQ ID NO: 969 - DNA, 1459 bp, Artificial Sequence
  Synthetic: Ptet-phoA-TNFa
ccaggatacatagattaccacaactccgagcccttccaccttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaacacaacacagaaaggagggctgtccatgaaacaatcaacgatcgctctggctctgcttccgctgctctttactccagttactaaagcgggtccgcagagggaagaattcccgcgcgatttgagcctgatttcacctcttgctcaggctgtccgctcctcttcgcgtaccccctcggataaacctgtcgcgcacgtggttgcgaacccgcaagcggaagggcagctgcaatggttaaaccgccgggctaatgcactgctggctaatggagttgagttacgcgacaaccaacttgtcgttccttcggaagggctgtatctgatctattcacaggttctctttaaagggcagggttgcccatcaacccacgtgctcctgacacacacgatcagtcgtatcgcggtatcctatcagacgaaagttaacctcctgtcagcgattaaatcgccgtgtcagagagaaactccagagggtgcggaagctaaaccgtggtatgaacctatttatcttggtggagttttccagttggaaaaaggtgatagactgtcggcagagatcaatcgccctgattacctggatttcgctgagtcgggtcaggtttatttcggaattattgcactgtgaaaataaaacgaaaggctcagtcgaaagactgggcctttcgttttatctgttggttccttatcatctggcgaatcggacccacaagagcactg

SEQ ID NO: 970 - DNA, 1342 bp, Artificial Sequence
  Synthetic: Ptet-phoA-IFNg
ccaggatacatagattaccacaactccgagcccttccaccttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaacaccaccaccacgaggaggtaaaaaatgaagcaatctacgatagcactggcgttgctgccgctgctgttcaccccggttaccaaggcgcaggatccttacgttaaagaagcagagaatctgaaaaaatactttaatgcaggccacagcgatgtggcagataatggcacgttattcctgggcattctgaaaaattggaaagaagaatctgaccggaagatcatgcaatctcagatcgtatcattttatttcaagttgtttaaaaacttcaaggatgaccagtcgattcaaaaatcagtggaaacgatcaaagaagatatgaacgttaagttcttcaactcaaataaaaaaaaacgcgatgatttcgaaaaactgactaattattcggtaactgatttgaatgttcagcgcaaggcgattcatgaattgattcaggttatggcagaactgtcgccagcggcaaaaacgggtaaacgaaaacgttctcagatgttgtttcgtggttgaaaataaaacgaaaggctcagtcgaaagactgggcctttcgttttatctgttggttccttatcatctggcgaatcggacccacaagagcactg

SEQ ID NO: 971-974 - skipped (4 entries)

SEQ ID NO: 975 - DNA, 5100 bp, Artificial Sequence
  Synthetic: ptet-J43scFv-V5-HIS (
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatcaagcttggtaccgagctcggatccactagtaacggccgccagtgtgctggaattcgcccttttaagacccactttcacatttaagttgtttttctaatccgcagatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaaaggaggtaaattatgcaattggaagttcgcctgttggagagcggtggtggacttgtgaaacccgagggaagccttaaactttcgtgcgttgctagtgggttcacattttcagactatttcatgtcctgggtccgtcaagccccgggaaaaggacttgaatgggttgcccatatttacaccaagagctataactatgccacatactattctggaagcgttaaaggtcgttttaccatttcgcgtgacgacagccgttctatggtgtatttgcagatgaataaccttcgtacagaagatacggctacttactactgtactcgcgatggatcaggctatcccagtttagatttctggggacagggtactcaggttactgtttcaagcggtggaggcggctctggcggtggtgggagtggaggcggtggcagttacgagctgacgcagccaccctcggcaagtgtaaacgtgggcgaaacggtgaaaattacttgttcgggggatcaactgcccaaatacttcgccgattggtttcatcaacgttccgatcagactattttacaagtgatttatgatgataacaaacgtccgtcaggaatcccagagcgtatcagcggatcgagcagcggaacaacagcaactttgaccatccgcgatgtccgtgccgaagacgagggggactactattgtttctctggatacgtggactcagacagcaagctgtatgtttttggctcaggaacacaactgaccgtactgggcaagggcgagctcaattcgaagcttgaaggtaagcctatccctaaccctctcctcggcctcgattctacgcgtaccggtcatcatcaccatcaccattgagcatgcggtctcaggaggaagggcgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 976 - DNA, 846 bp, Artificial Sequence
  Synthetic: J43-Anti-PD1-scFv-V5-HIS
atgcaattggaagttcgcctgttggagagcggtggtggacttgtgaaacccgagggaagccttaaactttcgtgcgttgctagtgggttcacattttcagactatttcatgtcctgggtccgtcaagccccgggaaaaggacttgaatgggttgcccatatttacaccaagagctataactatgccacatactattctggaagcgttaaaggtcgttttaccatttcgcgtgacgacagccgttctatggtgtatttgcagatgaataaccttcgtacagaagatacggctacttactactgtactcgcgatggatcaggctatcccagtttagatttctggggacagggtactcaggttactgtttcaagcggtggaggcggctctggcggtggtgggagtggaggcggtggcagttacgagctgacgcagccaccctcggcaagtgtaaacgtgggcgaaacggtgaaaattacttgttcgggggatcaactgcccaaatacttcgccgattggtttcatcaacgttccgatcagactattttacaagtgatttatgatgataacaaacgtccgtcaggaatcccagagcgtatcagcggatcgagcagcggaacaacagcaactttgaccatccgcgatgtccgtgccgaagacgagggggactactattgtttctctggatacgtggactcagacagcaagctgtatgtttttggctcaggaacacaactgaccgtactgggcaagggcgagctcaattcgaagcttgaaggtaagcctatccctaaccctctcctcggcctcgattctacgcgtaccggtcatcatcaccatcaccattga

SEQ ID NO: 977 - DNA, 363 bp, Artificial Sequence
  Synthetic: scFvHeavy chain
gaagttcgcctgttggagagcggtggtggacttgtgaaacccgagggaagccttaaactttcgtgcgttgctagtgggttcacattttcagactatttcatgtcctgggtccgtcaagccccgggaaaaggacttgaatgggttgcccatatttacaccaagagctataactatgccacatactattctggaagcgttaaaggtcgttttaccatttcgcgtgacgacagccgttctatggtgtatttgcagatgaataaccttcgtacagaagatacggctacttactactgtactcgcgatggatcaggctatcccagtttagatttctggggacagggtactcaggttactgtttcaagc

SEQ ID NO: 978 - DNA, 330 bp, Artificial Sequence
  Synthetic: scFvLight chain
tacgagctgacgcagccaccctcggcaagtgtaaacgtgggcgaaacggtgaaaattacttgttcgggggatcaactgcccaaatacttcgccgattggtttcatcaacgttccgatcagactattttacaagtgatttatgatgataacaaacgtccgtcaggaatcccagagcgtatcagcggatcgagcagcggaacaacagcaactttgaccatccgcgatgtccgtgccgaagacgagggggactactattgtttctctggatacgtggactcagacagcaagctgtatgtttttggctcaggaacacaactgaccgtactgggc

SEQ ID NO: 979 - DNA, 45 bp, Artificial Sequence
  Synthetic: scFvLinker
ggtggaggcggctctggcggtggtgggagtggaggcggtggcagt

SEQ ID NO: 980 - protein, 281 aa, Artificial Sequence
  Synthetic: J43-Anti-PD1-scFV polypeptide sequence
MQLEVRLLESGGGLVKPEGSLKLSCVASGFTFSDYFMSWVRQAPGKGLEWVAHIYTKSYNYATYYSGSVKGRFTISRDDSRSMVYLQMNNLRTEDTATYYCTRDGSGYPSLDFWGQGTQVTVSSGGGGSGGGGSGGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGKGELNSKLEGKPIPNPLLGLDSTRTGHHHHHH

SEQ ID NO: 981 - DNA, 1668 bp, Artificial Sequence
  Synthetic: Ptet-phoA-FLAG-J43-scFv-V5-HIS
ttaagacccactttcacatttaagttgtttttctaatccgcagatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacataattaattcctaatttttgttgacactctatcattgatagagttattttaccactccctatcagtgatagagaaaagtgaaaggaggtaaattatgactagtaaacaatcgaccatcgcattggcgctgcttcctctattgttcacaccggtgacaaaggcagtcgactataaggatgacgacgacaagcaattgggcggtggcatggaagttcgcctgttggagagcggtggaggacttgtgaagcccgagggaagccttaaactttcgtgcgttgctagtgggttcacattttcagactatttcatgtcctgggtccgtcaagccccgggaaaaggacttgaatgggttgcccatatttacaccaagagctataactatgccacatactattctggaagcgttaaaggtcgttttaccatttcgcgtgacgacagccgttctatggtgtatttgcagatgaataaccttcgtacagaagatacggctacttactactgtactcgcgatggatcaggctatcccagtttagatttctggggacagggtactcaggttactgtttcaagcggtggaggcggctctggcggtggtgggagtggaggcggtggcagttacgagctgacgcagccgccctcggcaagtgtaaacgtgggcgaaacggtgaaaattacttgttcgggggatcaactgcccaaatacttcgccgattggtttcatcaacgttccgatcagactattttacaagtgatttatgatgataacaaacgtccgtcaggaatcccagagcgtatcagcggatcgagcagcggaacaacagcaactttgaccatccgcgatgtccgtgccgaagacgagggggactactattgtttctctggatacgtggactcagacagcaagctgtatgtttttggctcaggaacacaactgaccgtactgggcaagggcgagctcaattcgaagcttgaaggtaagcctatccctaaccctctcctcggactcgattctacgggatccggtcatcatcaccatcaccattga

SEQ ID NO: 982 - protein, 313 aa, Artificial Sequence
  Synthetic: phoA-FLAG-J43-scFv-V5-HIS
KQSTIALALLPLLFTPVTKAVDYKDDDDKQLGGGMEVRLLESGGGLVKPEGSLKLSCVASGFTFSDYFMSWVRQAPGKGLEWVAHIYTKSYNYATYYSGSVKGRFTISRDDSRSMVYLQMNNLRTEDTATYYCTRDGSGYPSLDFWGQGTQVTVSSGGGGSGGGGSGGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGKGELNSKLEGKPIPNPLLGLDSTGSGHHHHHH

SEQ ID NO: 983 - DNA, 1674 bp, Artificial Sequence
  Synthetic: Ptet-ompF-FLAG-J43-scFv-V5-HIS
ttaagacccactttcacatttaagttgtttttctaatccgcagatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaaaggaggtaaattatgactagtatgatgaagcgtaacatcttagccgttattgtccccgcattgcttgtggccgggacggctaacgcagtcgactataaggatgacgacgacaagcaattgggcggtggcatggaagttcgcctgttggagagcggtggaggacttgtgaagcccgagggaagccttaaactttcgtgcgttgctagtgggttcacattttcagactatttcatgtcctgggtccgtcaagccccgggaaaaggacttgaatgggttgcccatatttacaccaagagctataactatgccacatactattctggaagcgttaaaggtcgttttaccatttcgcgtgacgacagccgttctatggtgtatttgcagatgaataaccttcgtacagaagatacggctacttactactgtactcgcgatggatcaggctatcccagtttagatttctggggacagggtactcaggttactgtttcaagcggtggaggcggctctggcggtggtgggagtggaggcggtggcagttacgagctgacgcagccgccctcggcaagtgtaaacgtgggcgaaacggtgaaaattacttgttcgggggatcaactgcccaaatacttcgccgattggtttcatcaacgttccgatcagactattttacaagtgatttatgatgataacaaacgtccgtcaggaatcccagagcgtatcagcggatcgagcagcggaacaacagcaactttgaccatccgcgatgtccgtgccgaagacgagggggactactattgtttctctggatacgtggactcagacagcaagctgtatgtttttggctcaggaacacaactgaccgtactgggcaagggcgagctcaattcgaagcttgaaggtaagcctatccctaaccctctcctcggactcgattctacgggatccggtcatcatcaccatcaccattga

SEQ ID NO: 984 - protein, 315 aa, Artificial Sequence
  Synthetic: ompF-FLAG-J43-scFv-V5-HIS
MMKRNILAVIVPALLVAGTANAVDYKDDDDKQLGGGMEVRLLESGGGLVKPEGSLKLSCVASGFTFSDYFMSWVRQAPGKGLEWVAHIYTKSYNYATYYSGSVKGRFTISRDDSRSMVYLQMNNLRTEDTATYYCTRDGSGYPSLDFWGQGTQVTVSSGGGGSGGGGSGGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGKGELNSKLEGKPIPNPLLGLDSTGSGHHHHHH

SEQ ID NO: 985 - DNA, 1668 bp, Artificial Sequence
  Synthetic: Ptet-PelB-FLAG-J43-scFv-V5-HIS
ttaagacccactttcacatttaagttgtttttctaatccgcagatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaaaggaggtaaattatgactagtaaatatcttcttccaacggctgctgctggtttattgcttcttgccgcccagcctgcgatggctgtcgactataaggatgacgacgacaagcaattgggcggtggcatggaagttcgcctgttggagagcggtggaggacttgtgaagcccgagggaagccttaaactttcgtgcgttgctagtgggttcacattttcagactatttcatgtcctgggtccgtcaagccccgggaaaaggacttgaatgggttgcccatatttacaccaagagctataactatgccacatactattctggaagcgttaaaggtcgttttaccatttcgcgtgacgacagccgttctatggtgtatttgcagatgaataaccttcgtacagaagatacggctacttactactgtactcgcgatggatcaggctatcccagtttagatttctggggacagggtactcaggttactgtttcaagcggtggaggcggctctggcggtggtgggagtggaggcggtggcagttacgagctgacgcagccgccctcggcaagtgtaaacgtgggcgaaacggtgaaaattacttgttcgggggatcaactgcccaaatacttcgccgattggtttcatcaacgttccgatcagactattttacaagtgatttatgatgataacaaacgtccgtcaggaatcccagagcgtatcagcggatcgagcagcggaacaacagcaactttgaccatccgcgatgtccgtgccgaagacgagggggactactattgtttctctggatacgtggactcagacagcaagctgtatgtttttggctcaggaacacaactgaccgtactgggcaagggcgagctcaattcgaagcttgaaggtaagcctatccctaaccctctcctcggactcgattctacgggatccggtcatcatcaccatcaccat

SEQ ID NO: 986 - protein, 314 aa, Artificial Sequence
  Synthetic: PelB-FLAG-J43-scFv-V5-HIS
KYLLPTAAAGLLLLAAQPAMAVDYKDDDDKQLGGGMEVRLLESGGGLVKPEGSLKLSCVASGFTFSDYFMSWVRQAPGKGLEWVAHIYTKSYNYATYYSGSVKGRFTISRDDSRSMVYLQMNNLRTEDTATYYCTRDGSGYPSLDFWGQGTQVTVSSGGGGSGGGGSGGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGKGELNSKLEGKPIPNPLLGLDSTGSGHHHHHH

SEQ ID NO: 987 - DNA, 5708 bp, Artificial Sequence
  Synthetic: p15A-Kan-ptet-Invasin-FLAG-J43scFv-V5-HIS
tagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaaggggtctgacgctcagtggaacggtgcaccctgcagggctagctgataaagcgttcgcgctgcattcggcagtttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaaaggaggtaaattatgactagtatggttttccaacccatcagcgaatttttgctgattcgtaacgctgggatgtccatgtattttaacaagatcatttcttttaacatcatttcacgtatcgttatttgcatttttcttatctgtggtatgttcatggccggtgcatctgaaaagtatgatgcaaacgcaccccaacaggtgcagccatactcggtttcatcatcagcgttcgagaatctgcaccccaataacgagatggagtcgagtatcaacccttttagtgcttcggacaccgagcgtaatgcagctatcatcgatcgtgctaacaaggaacaagaaacggaagcagtcaacaaaatgatctccactggcgctcgtttagctgccagcggtcgcgcgtccgatgtggcgcacagtatggtaggggatgcggtcaaccaggagattaaacaatggctgaatcgcttcggcactgctcaagtgaatttaaattttgacaagaacttctcgttaaaggagtcttcgcttgactggttggccccatggtacgattcggcgtcattccttttcttttctcagttgggcatccgtaacaaggacagtcgtaatacacttaaccttggtgttggcattcgcacattagaaaatggttggttgtatggcctgaacaccttttacgacaatgacttaacgggacacaatcaccgtatcgggctgggcgccgaggcgtggactgactacttgcagttagccgcgaatgggtacttccgtcttaatggttggcactcttcccgtgacttcagcgactacaaagaacgccctgctaccgggggagatttgcgtgcgaatgcgtacctgcccgctcttccgcaacttggcgggaagttaatgtatgagcagtatactggggaacgcgtggctctgttcggaaaggacaacctgcagcgcaacccatacgctgtcactgcgggtatcaactatacgccagttccgttgctgacggtcggcgtggatcaacgtatggggaagtcgagtaaacatgaaacgcaatggaatttacaaatgaactatcgcttaggggagagtttccaaagtcagcttagcccttcggcggtcgcagggactcgtttgcttgctgagtcccgctacaacctggttgatcgcaataacaatatcgtactggaataccagaaacaacaagtggttaagctgacgttgagccctgcgaccatcagtggattgcccggacaagtttaccaggtaaatgcccaggtccagggggcctctgcggttcgcgaaattgtctggtcagacgcagaattaatcgctgcaggaggcaccttaacgccactttccactacacaattcaatttagtccttcccccatacaaacgtaccgcccaggtatcgcgcgtaactgatgacttaactgctaatttttattcactgtcggcgttagcagttgaccatcaaggcaaccgtagtaattccttcacattatctgtaacggtgcagcagccgcaactgacgcttaccgcagcggtcattggtgatggggccccagctaatgggaaaaccgcaatcactgtcgagttcacagttgcagattttgaaggcaagccgctggcgggtcaggaggttgtgattacgactaataacggtgctcttcctaataagattactgaaaagactgacgctaacggcgttgcccgcattgcccttacgaacacaaccgatggggtcacggtagttaccgcagaggtcgaggggcaacgccaatccgttgacacgcacttcgttaagggtactatcgcggccgataaaagcacgctggccgcggtcgactataaggatgacgacgacaagcaattggaagttcgcctgttggagagcggtggtggacttgtgaaacccgagggaagccttaaactttcgtgcgttgctagtgggttcacattttcagactatttcatgtcctgggtccgtcaagccccgggaaaaggacttgaatgggttgcccatatttacaccaagagctataactatgccacatactattctggaagcgttaaaggtcgttttaccatttcgcgtgacgacagccgttctatggtgtatttgcagatgaataaccttcgtacagaagatacggctacttactactgtactcgcgatggatcaggctatcccagtttagatttctggggacagggtactcaggttactgtttcaagcggtggaggcggctctggcggtggtgggagtggaggcggtggcagttacgagctgacgcagccaccctcggcaagtgtaaacgtgggcgaaacggtgaaaattacttgttcgggggatcaactgcccaaatacttcgccgattggtttcatcaacgttccgatcagactattttacaagtgatttatgatgataacaaacgtccgtcaggaatcccagagcgtatcagcggatcgagcagcggaacaacagcaactttgaccatccgcgatgtccgtgccgaagacgagggggactactattgtttctctggatacgtggactcagacagcaagctgtatgtttttggctcaggaacacaactgaccgtactgggcaagggcgagctcaattcgaagcttgaaggtaagcctatccctaaccctctcctcggcctcgattctacgcgtaccggtcatcatcaccatcaccattgagcatgctaatcagccgtggaattcgcaacgtaaaaaaacccgccccggcgggtttttttataccggtctcaggaggaacgattggtaaacccggtgaacgcatgagaaagcccccggaagatcaccttccgggggcttttttattgcgcggaccaaaacgaaaaaagacgctcgaaagcgtctcttttctggaatttggtaccgaggcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgc

SEQ ID NO: 988 - DNA, 4282 bp, Artificial Sequence
  Synthetic: p15A-Kan-ptet-LppOmpA-FLAG-J43scFv-V5-HIS
tagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaaggggtctgacgctcagtggaacggtgcaccctgcagggctagctgataaagcgttcgcgctgcattcggcagtttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaaaggaggtaaattatgactagtaaagcaacaaaacttgtgttaggcgcggttatacttggctccaccctgcttgcaggttgctcgtctaacgcgaagatcgaccagggtatcaatccttacgtcgggtttgaaatgggatacgattggttgggacgtatgccttataagggaagtgttgaaaacggcgcttataaggcgcagggagtacagttaacggccaagcttgggtaccccataacagacgatttagatatttatacccgtttaggaggaatggtttggagagccgacacgaagtctaatgtatatggtaagaaccacgacacgggagtatcccccgtctttgcagggggagtggaatatgctatcacaccagagatcgctacccgtttggaatatcaatggacgaataatataggcgacgcccatacgataggaacgcggcccgacaacggcatccctggggtcgactataaggatgacgacgacaagcaattggaagttcgcctgttggagagcggtggtggacttgtgaaacccgagggaagccttaaactttcgtgcgttgctagtgggttcacattttcagactatttcatgtcctgggtccgtcaagccccgggaaaaggacttgaatgggttgcccatatttacaccaagagctataactatgccacatactattctggaagcgttaaaggtcgttttaccatttcgcgtgacgacagccgttctatggtgtatttgcagatgaataaccttcgtacagaagatacggctacttactactgtactcgcgatggatcaggctatcccagtttagatttctggggacagggtactcaggttactgtttcaagcggtggaggcggctctggcggtggtgggagtggaggcggtggcagttacgagctgacgcagccaccctcggcaagtgtaaacgtgggcgaaacggtgaaaattacttgttcgggggatcaactgcccaaatacttcgccgattggtttcatcaacgttccgatcagactattttacaagtgatttatgatgataacaaacgtccgtcaggaatcccagagcgtatcagcggatcgagcagcggaacaacagcaactttgaccatccgcgatgtccgtgccgaagacgagggggactactattgtttctctggatacgtggactcagacagcaagctgtatgtttttggctcaggaacacaactgaccgtactgggcaagggcgagctcaattcgaagcttgaaggtaagcctatccctaaccctctcctcggcctcgattctacgcgtaccggtcatcatcaccatcaccattgagcatgcgaattcggtctcaggaggaacgattggtaaacccggtgaacgcatgagaaagcccccggaagatcaccttccgggggcttttttattgcgcggaccaaaacgaaaaaagacgctcgaaagcgtctcttttctggaatttggtaccgaggcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgc

SEQ ID NO: 989 - DNA, 5864 bp, Artificial Sequence
  Synthetic: p15A-Kan-ptet-IntiminN-FLAG-J43scFv-V5-HIS
tagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaaggggtctgacgctcagtggaacggtgcaccctgcagggctagctgataaagcgttcgcgctgcattcggcagtttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaaaggaggtaaattatgactagtattacgcatggctgttatacccgtacgcgtcataaacacaagttgaagaaaactctgatcatgttatccgctggacttggactttttttttacgtgaatcagaactctttcgctaatggggaaaattattttaaactgggatcagacagcaaattacttacgcatgactcataccagaatcgtctgttttatacgctgaaaactggtgaaaccgttgcagatttaagtaaaagtcaggacattaacctgtcaactatttggtcacttaataaacacttatattcgagcgaatcggaaatgatgaaagctgcaccggggcaacaaatcatcttgcccctgaagaaattgccctttgaatactccgctttgcccttgctgggctcggctcctctggtagccgccggaggcgttgccggtcacactaataagctgacaaaaatgtcacccgacgtgacgaagagcaacatgacggatgataaggctttaaattacgcagctcagcaagcggcctcgttgggaagtcagttacagagtcgttcgttaaatggtgattatgctaaggataccgcattgggtattgccggcaaccaagcgtcgagccaacttcaggcatggttgcaacattacggcactgctgaagtaaatctgcaatcaggtaataattttgacggtagttccctggatttccttttacctttttacgattcagaaaagatgttggctttcggacaggtgggggcgcgttacatcgattcacgttttaccgctaacttgggggccggtcaacgcttcttcttacctgccaatatgttgggctataatgtatttatcgaccaggacttcagtggtgacaatacacgtctgggaattggtggagagtattggcgcgattactttaagtcatctgtaaatggctattttcgcatgagcggttggcatgaaagttacaacaagaaagactacgatgagcgccccgcgaacgggtttgacatccgttttaatggttatttgccatcttatcccgccttgggagctaaattaatctacgagcaatactatggagataacgtagctttgtttaatagcgacaagttacagtctaatccaggagcggctacagtgggagttaattataccccaatcccactggtcacaatgggaatcgattatcgccacgggactggtaatgaaaacgatttattatactccatgcagtttcgttatcagttcgataagagttggtcgcagcagattgagcctcaatatgttaacgaattacgtaccttgtccggcagtcgctacgatctggtacaacgcaataacaatatcatccttgagtataagaaacaggacattctgtctttgaacattccacatgatattaatggtaccgagcactcaacacaaaaaattcagctgattgtgaaatcaaagtatggactggaccgtatcgtgtgggatgatagcgctctgcgcagtcagggtggacagatccagcactcgggtagccagtctgcccaagactaccaggctatcctgccagcgtatgtccaagggggaagtaacatctacaaagttacagctcgcgcctattaccgcaacggtaattctagtaataatgtgcagttgacaattacggtgctgtccaatgggcaggtcgtcgatcaggtaggtgtgacggattttacagccgataaaacctctgcgaaggcagataacgcggataccatcacatacactgccactgtaaaaaaaaacggtgtcgcgcaggcaaacgttcctgttagcttcaacatcgtgtcgggtacagccacccttggggccaactcggcaaagactgacgcgaatggcaaggctacagtcacgttgaaatcctcgacaccaggacaggtcgttgtgtctgccaagacagcagagatgacctccgcccttaatgcatctgctgttatcttcttcgatcaaacgaaggcatctgtcgactataaggatgacgacgacaagcaattggaagttcgcctgttggagagcggtggtggacttgtgaaacccgagggaagccttaaactttcgtgcgttgctagtgggttcacattttcagactatttcatgtcctgggtccgtcaagccccgggaaaaggacttgaatgggttgcccatatttacaccaagagctataactatgccacatactattctggaagcgttaaaggtcgttttaccatttcgcgtgacgacagccgttctatggtgtatttgcagatgaataaccttcgtacagaagatacggctacttactactgtactcgcgatggatcaggctatcccagtttagatttctggggacagggtactcaggttactgtttcaagcggtggaggcggctctggcggtggtgggagtggaggcggtggcagttacgagctgacgcagccaccctcggcaagtgtaaacgtgggcgaaacggtgaaaattacttgttcgggggatcaactgcccaaatacttcgccgattggtttcatcaacgttccgatcagactattttacaagtgatttatgatgataacaaacgtccgtcaggaatcccagagcgtatcagcggatcgagcagcggaacaacagcaactttgaccatccgcgatgtccgtgccgaagacgagggggactactattgtttctctggatacgtggactcagacagcaagctgtatgtttttggctcaggaacacaactgaccgtactgggcaagggcgagctcaattcgaagcttgaaggtaagcctatccctaaccctctcctcggcctcgattctacgcgtaccggtcatcatcaccatcaccattgagcatgctaatcagccgtggaattcgcaacgtaaaaaaacccgccccggcgggtttttttataccggtctcaggaggaacgattggtaaacccggtgaacgcatgagaaagcccccggaagatcaccttccgggggcttttttattgcgcggaccaaaacgaaaaaagacgctcgaaagcgtctcttttctggaatttggtaccgaggcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgc

SEQ ID NO: 990 - protein, 607 aa, Artificial Sequence
  Synthetic: Invasin display tag
MVFQPISEFLLIRNAGMSMYFNKIISFNIISRIVICIFLICGMFMAGASEKYDANAPQQVQPYSVSSSAFENLHPNNEMESSINPFSASDTERNAAIIDRANKEQETEAVNKMISTGARLAASGRASDVAHSMVGDAVNQEIKQWLNRFGTAQVNLNFDKNFSLKESSLDWLAPWYDSASFLFFSQLGIRNKDSRNTLNLGVGIRTLENGWLYGLNTFYDNDLTGHNHRIGLGAEAWTDYLQLAANGYFRLNGWHSSRDFSDYKERPATGGDLRANAYLPALPQLGGKLMYEQYTGERVALFGKDNLQRNPYAVTAGINYTPVPLLTVGVDQRMGKSSKHETQWNLQMNYRLGESFQSQLSPSAVAGTRLLAESRYNLVDRNNNIVLEYQKQQVVKLTLSPATISGLPGQVYQVNAQVQGASAVREIVWSDAELIAAGGTLTPLSTTQFNLVLPPYKRTAQVSRVTDDLTANFYSLSALAVDHQGNRSNSFTLSVTVQQPQLTLTAAVIGDGAPANGKTAITVEFTVADFEGKPLAGQEVVITTNNGALPNKITEKTDANGVARIALTNTTDGVTVVTAEVEGQRQSVDTHFVKGTIAADKSTLAAV

SEQ ID NO: 991 - protein, 148 aa, Artificial Sequence
  Synthetic: LppOmpA display tag
KATKLVLGAVILGSTLLAGCSSNAKIDQGINPYVGFEMGYDWLGRMPYKGSVENGAYKAQGVQLTAKLGYPITDDLDIYTRLGGMVWRADTKSNVYGKNHDTGVSPVFAGGVEYAITPEIATRLEYQWTNNIGDAHTIGTRPDNGIPG

SEQ ID NO: 992 - protein, 658 aa, Artificial Sequence
  Synthetic: IntiminN display tag
ITHGCYTRTRHKHKLKKTLIMLSAGLGLFFYVNQNSFANGENYFKLGSDSKLLTHDSYQNRLFYTLKTGETVADLSKSQDINLSTIWSLNKHLYSSESEMMKAAPGQQIILPLKKLPFEYSALPLLGSAPLVAAGGVAGHTNKLTKMSPDVTKSNMTDDKALNYAAQQAASLGSQLQSRSLNGDYAKDTALGIAGNQASSQLQAWLQHYGTAEVNLQSGNNFDGSSLDFLLPFYDSEKMLAFGQVGARYIDSRFTANLGAGQRFFLPANMLGYNVFIDQDFSGDNTRLGIGGEYWRDYFKSSVNGYFRMSGWHESYNKKDYDERPANGFDIRFNGYLPSYPALGAKLIYEQYYGDNVALFNSDKLQSNPGAATVGVNYTPIPLVTMGIDYRHGTGNENDLLYSMQFRYQFDKSWSQQIEPQYVNELRTLSGSRYDLVQRNNNIILEYKKQDILSLNIPHDINGTEHSTQKIQLIVKSKYGLDRIVWDDSALRSQGGQIQHSGSQSAQDYQAILPAYVQGGSNIYKVTARAYYRNGNSSNNVQLTITVLSNGQVVDQVGVTDFTADKTSAKADNADTITYTATVKKNGVAQANVPVSFNIVSGTATLGANSAKTDANGKATVTLKSSTPGQVVVSAKTAEMTSALNASAVIFFDQTKAS

SEQ ID NO: 993 - DNA, 5121 bp, Artificial Sequence
  Synthetic: pUC-ptet-B6H12antihCD47scFv-V5-HIS
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatcaagcttggtaccgagctcggatccactagtaacggccgccagtgtgctggaattcgcccttttaagacccactttcacatttaagttgtttttctaatccgcagatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaaaggaggtaaattcatatgactagtcaattgggtggtagcgaggtccagctggtggaatctggcggagacttagtaaagccgggaggttcgttgaagttgagttgcgctgctagtgggtttacgtttagcggctatggtatgtcatgggtccgccaaacacccgataaacgtttagagtgggtcgccacgattacgagtggaggcacctacacctattatccggattctgtcaaaggccgctttactatttctcgtgataatgcaaagaacaccttatatttacagatcgactccttgaagtctgaggataccgcaatttatttctgtgcccgttcgttagccggtaatgctatggattattgggggcaaggcacatctgtcacagtctcatccggaggaggcggatcaggtggtggcggttctggcggcggcggatctgacattgtgatgacacaatcacctgcgacactttcggttactccaggagaccgcgttagcttgtcgtgtcgcgcctctcaaaccatcagtgactacttacattggtaccaacagaaatcccatgaatcgccacgcttacttattaagtttgcgtcccaatcaattagtggtattccgtcgcgctttagtggtagcggttctggttctgatttcacattgtcaatcaacagcgtggagccggaggatgttggtgtttactactgccaaaacggtcacggctttccacgtacattcggagggggaacgaagttggaaattaaaggcagcggcgagctcggtggcagtggtaagcctatccctaaccctctcctcggcctcgattctacgggatccggtcatcatcaccatcaccattgagcatgctaatcagccgtggaattcgaattcggtctcaggaggaagggcgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 994 - protein, 240 aa, Artificial Sequence
  Synthetic: B6H12-anti-CD47-scFv polypeptide sequence
EVQLVESGGDLVKPGGSLKLSCAASGFTFSGYGMSWVRQTPDKRLEWVATITSGGTYTYYPDSVKGRFTISRDNAKNTLYLQIDSLKSEDTAIYFCARSLAGNAMDYWGQGTSVTVSSGGGGSGGGGSGGGGSDIVMTQSPATLSVTPGDRVSLSCRASQTISDYLHWYQQKSHESPRLLIKFASQSISGIPSRFSGSGSGSDFTLSINSVEPEDVGVYYCQNGHGFPRTFGGGTKLEIK

SEQ ID NO: 995 - DNA, 5133 bp, Artificial Sequence
  Synthetic: pUC-ptet-5F9antihCD47scFv-V5-HIS
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatcaagcttggtaccgagctcggatccactagtaacggccgccagtgtgctggaattcgcccttttaagacccactttcacatttaagttgtttttctaatccgcagatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaaaggaggtaaattcatatgactagtcaattgggtggtagccaggtgcagcttgtgcagagtggcgctgaagtgaagaaaccgggcgcatcagtgaaagtgagctgcaaagcaagcggttataccttcacgaactataacatgcactgggtacgtcaagcacccggccagcgtcttgagtggatgggcaccatttatcctggaaacgacgacacatcctacaaccaaaagtttaaggaccgcgtaactatcactgctgacacttcagcttccacagcatatatggagcttagtagcctgcgtagtgaagacacagcggtctactactgcgcacgtggagggtatcgtgcgatggactactgggggcagggcacacttgtgactgtttcatctggcggtggaggctctggaggggggggtagcggggggggcggtagcgatatcgtaatgactcagtccccactttccttacccgtcacaccgggcgaacctgcatctattagctgtcgttcgtcgcaaagcattgtttactcgaatgggaatacgtacttggggtggtatcttcaaaaaccagggcagtcccctcagttgttgatctacaaggtgtccaaccgctttagtggggtgcctgatcgtttctctggcagtggtagtggtaccgacttcacgcttaaaatttcccgtgtcgaagcagaagacgttggcgtatattactgcttccaaggcagtcatgtgccatacacgttcgggcaaggcaccaaacttgagatcaaaggcagcggcgagctcggtggcagtggtaagcctatccctaaccctctcctcggcctcgattctacgggatccggtcatcatcaccatcaccattgagcatgctaatcagccgtggaattcgaattcggtctcaggaggaagggcgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 996 - protein, 244 aa, Artificial Sequence
  Synthetic: 5F9-anti-CD47-scFv polypeptide sequence
QVQLVQSGAEVKKPGASVKVSCKASGYTFTNYNMHWVRQAPGQRLEWMGTIYPGNDDTSYNQKFKDRVTITADTSASTAYMELSSLRSEDTAVYYCARGGYRAMDYWGQGTLVTVSSGGGGSGGGGSGGGGSDIVMTQSPLSLPVTPGEPASISCRSSQSIVYSNGNTYLGWYLQKPGQSPQLLIYKVSNRFSGVPDRFSGSGSGTDFTLKISRVEAEDVGVYYCFQGSHVPYTFGQGTKLEIK

SEQ ID NO: 997 - DNA, 2555 bp, Artificial Sequence
  Synthetic: Biosafety Plasmid System Component  dap A
actcttcctttttcaatattattgaagcatttatcagggttattgtctcatgagcggatacatatttgaatgtatttagaaaaataaacaaataggggaattaaaaaaaagcccgctcattaggcgggctactacctaggccgcggccgcgcgaattcgagctcggtacccggggatcctctagagtcgacctgcaggcatgcaagcttgcggccgcgtcgtgactgggaaaaccctggcgactagtcttggactcctgttgatagatccagtaatgacctcagaactccatctggatttgttcagaacgctcggttgccgccgggcgttttttattggtgagaatccaggggtccccaataattacgatttaaatcacagcaaacaccacgtcggccctatcagctgcgtgctttctatgagtcgttgctgcataacttgacaattaacatccggctcgtagggtttgtggagggcccaagttcacttaaaaaggagatcaacaatgaaagcaattttcgtactgaaacatcttaatcatgctggggagggtttctaatgttcacgggaagtattgtcgcgattgttactccgatggatgaaaaaggtaatgtctgtcgggctagcttgaaaaaactgattgattatcatgtcgccagcggtacttcggcgatcgtttctgttggcaccactggcgagtccgctaccttaaatcatgacgaacatgctgatgtggtgatgatgacgctggatctggctgatgggcgcattccggtaattgccgggaccggcgctaacgctactgcggaagccattagcctgacgcagcgcttcaatgacagtggtatcgtcggctgcctgacggtaaccccttactacaatcgtccgtcgcaagaaggtttgtatcagcatttcaaagccatcgctgagcatactgacctgccgcaaattctgtataatgtgccgtcccgtactggctgcgatctgctcccggaaacggtgggccgtctggcgaaagtaaaaaatattatcggaatcaaagaggcaacagggaacttaacgcgtgtaaaccagatcaaagagctggtttcagatgattttgttctgctgagcggcgatgatgcgagcgcgctggacttcatgcaattgggcggtcatggggttatttccgttacggctaacgtcgcagcgcgtgatatggcccagatgtgcaaactggcagcagaagggcattttgccgaggcacgcgttattaatcagcgtctgatgccattacacaacaaactatttgtcgaacccaatccaatcccggtgaaatgggcatgtaaggaactgggtcttgtggcgaccgatacgctgcgcctgccaatgacaccaatcaccgacagtggccgtgagacggtcagagcggcgcttaaacatgccggtttgctgtaagacttttgtcaggttcctactgtgacgactaccaccgatagactggagtgttgctgcgaaaaaaccccgccgaagcggggttttttgcgagaagtcaccacgattgtgctttacacggagtagtcggcagttccttaagtcagaatagtggacaggcggccaagaacttcgttcatgatagtctccggaacccgttcgagtcgttttccgccccgtgctttcatatcaattgtccggggttgatcgcaacgtacaacacctgtggtacgtatgccaacaccatccaacgacaccgcaaagccggcagtgcgggcaaaattgcctccgctggttacgggcacaacaacaggcaggcgggtcacgcgattaaaggccgccggtgtgacaatcagcaccggccgcgttccctgctgctcatgacctgcggtaggatcaagcgagacaagccagatttcccctctttccatctagtataactattgtttctctagtaacatttattgtacaacacgagcccatttttgtcaaataaattttaaattatatcaacgttaataagacgttgtcaataaaattattttgacaaaattggccggccggcgcgccgatctgaagatcagcagttcaacctgttgatagtacgtactaagctctcatgtttcacgtactaagctctcatgtttaacgtactaagctctcatgtttaacgaactaaaccctcatggctaacgtactaagctctcatggctaacgtactaagctctcatgtttcacgtactaagctctcatgtttgaacaataaaattaatataaatcagcaacttaaatagcctctaaggttttaagttttataagaaaaaaaagaatatataaggcttttaaagcctttaaggtttaacggttgtggacaacaagccagggatgtaacgcactgagaagcccttagagcctctcaaagcaattttgagtgacacaggaacacttaacggctgacatggggcgcgcccagctgtctagggcggcggatttgtcctactcaggagagcgttcaccgacaaacaacagataaaacgaaaggcccagtctttcgactgagcctttcgttttatttgatgcct

SEQ ID NO: 998 - DNA, 2472 bp, Artificial Sequence
  Synthetic: Biosafety Plasmid System Component  ThyA
actcttcctttttcaatattattgaagcatttatcagggttattgtctcatgagcggatacatatttgaatgtatttagaaaaataaacaaataggggaattaaaaaaaagcccgctcattaggcgggctactacctaggccgcggccgcgcgaattcgagctcggtacccggggatcctctagagtcgacctgcaggcatgcaagcttgcggccgcgtcgtgactgggaaaaccctggcgactagtcttggactcctgttgatagatccagtaatgacctcagaactccatctggatttgttcagaacgctcggttgccgccgggcgttttttattggtgagaatccaggggtccccaataattacgatttaaatcacagcaaacaccacgtcggccctatcagctgcgtgctttctatgagtcgttgctgcataacttgacaattaatcatccggctcgtagggtttgtggagggcccaagttcacttaaaaaggagatcaacaatgaaagcaattttcgtactgaaacatcttaatcatgctggggagggtttctaatgaaacagtatttagaactgatgcaaaaagtgctcgacgaaggcacacagaaaaacgaccgtaccggaaccggaacgctttccatttttggtcatcagatgcgttttaacctgcaagatggattcccgctggtgacaactaaacgttgccacctgcgttccatcatccatgaactgctgtggtttcttcagggcgacactaacattgcttatctacacgaaaacaatgtcaccatctgggacgaatgggccgatgaaaacggcgacctcgggccagtgtatggtaaacagtggcgtgcctggccaacgccagatggtcgtcatattgaccagatcactacggtactgaaccagctgaaaaacgacccggattcgcgccgcattattgtttcagcgtggaacgtaggcgaactggataaaatggcgctggcaccgtgccatgcattcttccagttctatgtggcagacggcaaactctcttgccagctttatcagcgctcctgtgacgtcttcctcggcctgccgttcaacattgccagctacgcgttattggtgcatatgatggcgcagcagtgcgatctggaagtgggtgattttgtctggaccggtggcgacacgcatctgtacagcaaccatatggatcaaactcatctgcaattaagccgcgaaccgcgtccgctgccgaagttgattatcaaacgtaaacccgaatccatcttcgactaccgtttcgaagactttgagattgaaggctacgatccgcatccgggcattaaagcgccggtggctatctaagacttttgtcaggttcctactgtgacgactaccaccgatagactggagtgttgctgcgaaaaaaccccgccgaagcggggttttttgcgagaagtcaccacgattgtgctttacacggagtagtcggcagttccttaagtcagaatagtggacaggcggccaagaacttcgttcatgatagtctccggaacccgttcgagtcgttttccgccccgtgctttcatatcaattgtccggggttgatcgcaacgtacaacacctgtggtacgtatgccaacaccatccaacgacaccgcaaagccggcagtgcgggcaaaattgcctccgctggttacgggcacaacaacaggcaggcgggtcacgcgattaaaggccgccggtgtgacaatcagcaccggccgcgttccctgctgctcatgacctgcggtaggatcaagcgagacaagccagatttcccctctttccatctagtataactattgtttctctagtaacatttattgtacaacacgagcccatttttgtcaaataaattttaaattatatcaacgttaataagacgttgtcaataaaattattttgacaaaattggccggccggcgcgccgatctgaagatcagcagttcaacctgttgatagtacgtactaagctctcatgtttcacgtactaagctctcatgtttaacgtactaagctctcatgtttaacgaactaaaccctcatggctaacgtactaagctctcatggctaacgtactaagctctcatgtttcacgtactaagctctcatgtttgaacaataaaattaatataaatcagcaacttaaatagcctctaaggttttaagttttataagaaaaaaaagaatatataaggcttttaaagcctttaaggtttaacggttgtggacaacaagccagggatgtaacgcactgagaagcccttagagcctctcaaagcaattttgagtgacacaggaacacttaacggctgacatggggcgcgcccagctgtctagggcggcggatttgtcctactcaggagagcgttcaccgacaaacaacagataaaacgaaaggcccagtctttcgactgagcctttcgttttatttgatgcct

SEQ ID NO: 999 - DNA, 333 bp, Artificial Sequence
  Synthetic: Kid toxin (reverse orientation)
ttaagtcagaatagtggacaggcggccaagaacttcgttcatgatagtctccggaacccgttcgagtcgttttccgccccgtgctttcatatcaattgtccggggttgatcgcaacgtacaacacctgtggtacgtatgccaacaccatccaacgacaccgcaaagccggcagtgcgggcaaaattgcctccgctggttacgggcacaacaacaggcaggcgggtcacgcgattaaaggccgccggtgtgacaatcagcaccggccgcgttccctgctgctcatgacctgcggtaggatcaagcgagacaagccagatttcccctctttccat

SEQ ID NO: 1000 - DNA, 879 bp, Artificial Sequence
  Synthetic: dapA
atgttcacgggaagtattgtcgcgattgttactccgatggatgaaaaaggtaatgtctgtcgggctagcttgaaaaaactgattgattatcatgtcgccagcggtacttcggcgatcgtttctgttggcaccactggcgagtccgctaccttaaatcatgacgaacatgctgatgtggtgatgatgacgctggatctggctgatgggcgcattccggtaattgccgggaccggcgctaacgctactgcggaagccattagcctgacgcagcgcttcaatgacagtggtatcgtcggctgcctgacggtaaccccttactacaatcgtccgtcgcaagaaggtttgtatcagcatttcaaagccatcgctgagcatactgacctgccgcaaattctgtataatgtgccgtcccgtactggctgcgatctgctcccggaaacggtgggccgtctggcgaaagtaaaaaatattatcggaatcaaagaggcaacagggaacttaacgcgtgtaaaccagatcaaagagctggtttcagatgattttgttctgctgagcggcgatgatgcgagcgcgctggacttcatgcaattgggcggtcatggggttatttccgttacggctaacgtcgcagcgcgtgatatggcccagatgtgcaaactggcagcagaagggcattttgccgaggcacgcgttattaatcagcgtctgatgccattacacaacaaactatttgtcgaacccaatccaatcccggtgaaatgggcatgtaaggaactgggtcttgtggcgaccgatacgctgcgcctgccaatgacaccaatcaccgacagtggccgtgagacggtcagagcggcgcttaaacatgccggtttgctgtaa

SEQ ID NO: 1001 - DNA, 795 bp, Artificial Sequence
  Synthetic: thyA
atgaaacagtatttagaactgatgcaaaaagtgctcgacgaaggcacacagaaaaacgaccgtaccggaaccggaacgctttccatttttggtcatcagatgcgttttaacctgcaagatggattcccgctggtgacaactaaacgttgccacctgcgttccatcatccatgaactgctgtggtttcttcagggcgacactaacattgcttatctacacgaaaacaatgtcaccatctgggacgaatgggccgatgaaaacggcgacctcgggccagtgtatggtaaacagtggcgtgcctggccaacgccagatggtcgtcatattgaccagatcactacggtactgaaccagctgaaaaacgacccggattcgcgccgcattattgtttcagcgtggaacgtaggcgaactggataaaatggcgctggcaccgtgccatgcattcttccagttctatgtggcagacggcaaactctcttgccagctttatcagcgctcctgtgacgtcttcctcggcctgccgttcaacattgccagctacgcgttattggtgcatatgatggcgcagcagtgcgatctggaagtgggtgattttgtctggaccggtggcgacacgcatctgtacagcaaccatatggatcaaactcatctgcaattaagccgcgaaccgcgtccgctgccgaagttgattatcaaacgtaaacccgaatccatcttcgactaccgtttcgaagactttgagattgaaggctacgatccgcatccgggcattaaagcgccggtggctatctaa

SEQ ID NO: 1002 - protein, 110 aa, Artificial Sequence
  Synthetic: Kid toxin polypeptide
MERGEIWLVSLDPTAGHEQQGTRPVLIVTPAAFNRVTRLPVVVPVTSGGNFARTAGFAVSLDGVGIRTTGVVRCDQPRTIDMKARGGKRLERVPETIMNEVLGRLSTILT

SEQ ID NO: 1003 - protein, 292 aa, Artificial Sequence
  Synthetic: dapA polypeptide
MFTGSIVAIVTPMDEKGNVCRASLKKLIDYHVASGTSAIVSVGTTGESATLNHDEHADVVMMTLDLADGRIPVIAGTGANATAEAISLTQRFNDSGIVGCLTVTPYYNRPSQEGLYQHFKAIAEHTDLPQILYNVPSRTGCDLLPETVGRLAKVKNIIGIKEATGNLTRVNQIKELVSDDFVLLSGDDASALDFMQLGGHGVISVTANVAARDMAQMCKLAAEGHFAEARVINQRLMPLHNKLFVEPNPIPVKWACKELGLVATDTLRLPMTPITDSGRETVRAALKHAGLL

SEQ ID NO: 1004 - protein, 264 aa, Artificial Sequence
  Synthetic: ThyA polypeptide
MKQYLELMQKVLDEGTQKNDRTGTGTLSIFGHQMRFNLQDGFPLVTTKRCHLRSIIHELLWFLQGDTNIAYLHENNVTIWDEWADENGDLGPVYGKQWRAWPTPDGRHIDQITTVLNQLKNDPDSRRIIVSAWNVGELDKMALAPCHAFFQFYVADGKLSCQLYQRSCDVFLGLPFNIASYALLVHMMAQQCDLEVGDFVWTGGDTHLYSNHMDQTHLQLSREPRPLPKLIIKRKPESIFDYRFEDFEIEGYDPHPGIKAPVAI

SEQ ID NO: 1005 - DNA, 1490 bp, Artificial Sequence
  Synthetic: Biosafety Chromosomal Construct -  low copy Rep (Pi) and Kis antitoxin (as shown in Fig. 76C)
ttgacggctagctcagtcctaggtacagtgctagcggatctgctggaacaggtggtgagactcaaggtcatgatggacgtgaacaaaaaaacgaaaattcgccaccgaaacgagctaaatcacaccctggctcaacttcctttgcccgcaaagcgagtgatgtatatggcgcttgctcccattgatagcaaagaacctcttgaacgagggcgagttttcaaaattagggctgaagaccttgcagcgctcgccaaaatcaccccatcgcttgcttatcgacaattaaaagagggtggtaaattacttggtgccagcaaaatttcgctaagaggggatgatatcattgctttagctaaagagcttaacctgctctttactgctaaaaactcccctgaagagttagaccttaacattattgagtggatagcttattcaaatgatgaaggatacttgtctttaaaattcaccagaaccatagaaccatatatctctagccttattgggaaaaaaaataaattcacaacgcaattgttaacggcaagcttacgcttaagtagccagtattcatcttctctttatcaacttatcaggaagcattactctaattttaagaagaaaaattattttattatttccgttgatgagttaaaggaagagttaatagcttatacttttgataaagatggaaatattgagtacaaataccctgactttcctatttttaaaagggatgtgttaaataaagccattgctgaaattaaaaagaaaacagaaatatcgtttgttggcttcactgttcatgaaaaagaaggaagaaaaattagtaagctgaagttcgaatttgtcgttgatgaagatgaattttctggcgataaagatgatgaagctttttttatgaatttatctgaagctgatgcagcttttctcaaggtatttgatgaaaccgtacctcccaaaaaagctaaggggtgaggatctccaggcatcaaataaaacgaaaggctcagtcgaaagactgggcctttcgttttatctgttgtttgtcggtgaacgctctctactagagtcacactggctcaccttcgggtgggcctttctgcgtttatacccgggaaaaagagtattgacttaaagtctaacctataggtataatgtgtggagaccagaggtaaggaggtaacaaccatgcgagtgttgaagaaacatcttaatcatgctaaggaggttttctaatgcataccacccgactgaagagggttggcggctcagttatgctgaccgtcccaccggcactgctgaatgcgctgtctctgggcacagataatgaagttggcatggtcattgataatggccggctgattgttgagccgtacagacgcccgcaatattcactggctgagctactggcacagtgtgatccgaatgctgaaatatcagctgaagaacgagaatggctggatgcaccggcgactggtcaggaggaaatctga

SEQ ID NO: 1006 - DNA, 1490 bp, Artificial Sequence
  Synthetic: Biosafety Chromosomal Construct -  medium copy Rep (Pi) and Kis antitoxin (as shown in Fig. 76D)
ttgacggctagctcagtcctaggtacagtgctagcggatcttccggaagactaggtgagactcaaggtcatgatggacgtgaacaaaaaaacgaaaattcgccaccgaaacgagctaaatcacaccctggctcaacttcctttgcccgcaaagcgagtgatgtatatggcgcttgctcccattgatagcaaagaacctcttgaacgagggcgagttttcaaaattagggctgaagaccttgcagcgctcgccaaaatcaccccatcgcttgcttatcgacaattaaaagagggtggtaaattacttggtgccagcaaaatttcgctaagaggggatgatatcattgctttagctaaagagcttaacctgctctttactgctaaaaactcccctgaagagttagaccttaacattattgagtggatagcttattcaaatgatgaaggatacttgtctttaaaattcaccagaaccatagaaccatatatctctagccttattgggaaaaaaaataaattcacaacgcaattgttaacggcaagcttacgcttaagtagccagtattcatcttctctttatcaacttatcaggaagcattactctaattttaagaagaaaaattattttattatttccgttgatgagttaaaggaagagttaatagcttatacttttgataaagatggaaatattgagtacaaataccctgactttcctatttttaaaagggatgtgttaaataaagccattgctgaaattaaaaagaaaacagaaatatcgtttgttggcttcactgttcatgaaaaagaaggaagaaaaattagtaagctgaagttcgaatttgtcgttgatgaagatgaattttctggcgataaagatgatgaagctttttttatgaatttatctgaagctgatgcagcttttctcaaggtatttgatgaaaccgtacctcccaaaaaagctaaggggtgaggatctccaggcatcaaataaaacgaaaggctcagtcgaaagactgggcctttcgttttatctgttgtttgtcggtgaacgctctctactagagtcacactggctcaccttcgggtgggcctttctgcgtttatacccgggaaaaagagtattgacttaaagtctaacctataggtataatgtgtggagaccagaggtaaggaggtaacaaccatgcgagtgttgaagaaacatcttaatcatgctaaggaggttttctaatgcataccacccgactgaagagggttggcggctcagttatgctgaccgtcccaccggcactgctgaatgcgctgtctctgggcacagataatgaagttggcatggtcattgataatggccggctgattgttgagccgtacagacgcccgcaatattcactggctgagctactggcacagtgtgatccgaatgctgaaatatcagctgaagaacgagaatggctggatgcaccggcgactggtcaggaggaaatctga

SEQ ID NO: 1007 - DNA, 917 bp, Artificial Sequence
  Synthetic: Rep (Pi)
tgagactcaaggtcatgatggacgtgaacaaaaaaacgaaaattcgccaccgaaacgagctaaatcacaccctggctcaacttcctttgcccgcaaagcgagtgatgtatatggcgcttgctcccattgatagcaaagaacctcttgaacgagggcgagttttcaaaattagggctgaagaccttgcagcgctcgccaaaatcaccccatcgcttgcttatcgacaattaaaagagggtggtaaattacttggtgccagcaaaatttcgctaagaggggatgatatcattgctttagctaaagagcttaacctgctctttactgctaaaaactcccctgaagagttagaccttaacattattgagtggatagcttattcaaatgatgaaggatacttgtctttaaaattcaccagaaccatagaaccatatatctctagccttattgggaaaaaaaataaattcacaacgcaattgttaacggcaagcttacgcttaagtagccagtattcatcttctctttatcaacttatcaggaagcattactctaattttaagaagaaaaattattttattatttccgttgatgagttaaaggaagagttaatagcttatacttttgataaagatggaaatattgagtacaaataccctgactttcctatttttaaaagggatgtgttaaataaagccattgctgaaattaaaaagaaaacagaaatatcgtttgttggcttcactgttcatgaaaaagaaggaagaaaaattagtaagctgaagttcgaatttgtcgttgatgaagatgaattttctggcgataaagatgatgaagctttttttatgaatttatctgaagctgatgcagcttttctcaaggtatttgatgaaaccgtacctcccaaaaaagctaaggggtga

SEQ ID NO: 1008 - DNA, 255 bp, Artificial Sequence
  Synthetic: Kis antitoxin
cataccacccgactgaagagggttggcggctcagttatgctgaccgtcccaccggcactgctgaatgcgctgtctctgggcacagataatgaagttggcatggtcattgataatggccggctgattgttgagccgtacagacgcccgcaatattcactggctgagctactggcacagtgtgatccgaatgctgaaatatcagctgaagaacgagaatggctggatgcaccggcgactggtcaggaggaaatctga

SEQ ID NO: 1009 - DNA, 14 bp, Artificial Sequence
  Synthetic: RBS (low copy)
gctggaacaggtgg

SEQ ID NO: 1010 - DNA, 14 bp, Artificial Sequence
  Synthetic: RBS (medium copy)
tccggaagactagg

SEQ ID NO: 1011 - DNA, 60 bp, Artificial Sequence
  Synthetic: SR36
tagaactgatgcaaaaagtgctcgacgaaggcacacagatgtgtaggctggagctgcttc

SEQ ID NO: 1012 - DNA, 60 bp, Artificial Sequence
  Synthetic: SR38
gtttcgtaattagatagccaccggcgctttaatgcccggacatatgaatatcctccttag

SEQ ID NO: 1013 - DNA, 52 bp, Artificial Sequence
  Synthetic: SR33
caacacgtttcctgaggaaccatgaaacagtatttagaactgatgcaaaaag

SEQ ID NO: 1014 - DNA, 36 bp, Artificial Sequence
  Synthetic: SR43
atatcgtcgcagcccacagcaacacgtttcctgagg

SEQ ID NO: 1015 - DNA, 47 bp, Artificial Sequence
  Synthetic: SR44
aagaatttaacggagggcaaaaaaaaccgacgcacactggcgtcggc

SEQ ID NO: 1016 - DNA, 967 bp, Artificial Sequence
  Synthetic: Wild-type clbA
caaatatcacataatcttaacatatcaataaacacagtaaagtttcatgtgaaaaacatcaaacataaaatacaagctcggaatacgaatcacgctatacacattgctaacaggaatgagattatctaaatgaggattgatatattaattggacatactagtttttttcatcaaaccagtagagataacttccttcactatctcaatgaggaagaaataaaacgctatgatcagtttcattttgtgagtgataaagaactctatattttaagccgtatcctgctcaaaacagcactaaaaagatatcaacctgatgtctcattacaatcatggcaatttagtacgtgcaaatatggcaaaccatttatagtttttcctcagttggcaaaaaagattttttttaacctttcccatactatagatacagtagccgttgctattagttctcactgcgagcttggtgtcgatattgaacaaataagagatttagacaactcttatctgaatatcagtcagcatttttttactccacaggaagctactaacatagtttcacttcctcgttatgaaggtcaattacttttttggaaaatgtggacgctcaaagaagcttacatcaaatatcgaggtaaaggcctatctttaggactggattgtattgaatttcatttaacaaataaaaaactaacttcaaaatatagaggttcacctgtttatttctctcaatggaaaatatgtaactcatttctcgcattagcctctccactcatcacccctaaaataactattgagctatttcctatgcagtcccaactttatcaccacgactatcagctaattcattcgtcaaatgggcagaattgaatcgccacggataatctagacacttctgagccgtcgataatattgattttcatattccgtcggtggtgtaagtatcccgcataatcgtgccattcacatttag

SEQ ID NO: 1017 - DNA, 424 bp, Artificial Sequence
  Synthetic: clbA knockout
ggatggggggaaacatggataagttcaaagaaaaaaacccgttatctctgcgtgaaagacaagtattgcgcatgctggcacaaggtgatgagtactctcaaatatcacataatcttaacatatcaataaacacagtaaagtttcatgtgaaaaacatcaaacataaaatacaagctcggaatacgaatcacgctatacacattgctaacaggaatgagattatctaaatgaggattgatgtgtaggctggagctgcttcgaagttcctatactttctagagaataggaacttcggaataggaacttcggaataggaactaaggaggatattcatatgtcgtcaaatgggcagaattgaatcgccacggataatctagacacttctgagccgtcgataatattgattttcatattccgtcggtgg

SEQ ID NO: 1018 - DNA, 28 bp, Artificial Sequence
  Synthetic: Master Sequence
  misc_feature (13)..(15): n is a, c, g, or t
  misc_feature (18)..(20): n is a, c, g, or t
tctagagaaagannngannnactagatg

SEQ ID NO: 1019 - DNA, 28 bp, Artificial Sequence
  Synthetic: BBa_J61100
tctagagaaagaggggacaaactagatg

SEQ ID NO: 1020 - DNA, 28 bp, Artificial Sequence
  Synthetic: BBa_J61101
tctagagaaagacaggacccactagatg

SEQ ID NO: 1021 - DNA, 28 bp, Artificial Sequence
  Synthetic: BBa_J61102
tctagagaaagatccgatgtactagatg

SEQ ID NO: 1022 - DNA, 28 bp, Artificial Sequence
  Synthetic: BBa_J61103
tctagagaaagattagacaaactagatg

SEQ ID NO: 1023 - DNA, 28 bp, Artificial Sequence
  Synthetic: BBa_J61104
tctagagaaagaagggacagactagatg

SEQ ID NO: 1024 - DNA, 28 bp, Artificial Sequence
  Synthetic: BBa_J61105
tctagagaaagacatgacgtactagatg

SEQ ID NO: 1025 - DNA, 28 bp, Artificial Sequence
  Synthetic: BBa_J61106
tctagagaaagataggagacactagatg

SEQ ID NO: 1026 - DNA, 28 bp, Artificial Sequence
  Synthetic: BBa_J61107
tctagagaaagaagagactcactagatg

SEQ ID NO: 1027 - DNA, 28 bp, Artificial Sequence
  Synthetic: BBa_J61108
tctagagaaagacgagatatactagatg

SEQ ID NO: 1028 - DNA, 28 bp, Artificial Sequence
  Synthetic: BBa_J61109
tctagagaaagactggagacactagatg

SEQ ID NO: 1029 - DNA, 28 bp, Artificial Sequence
  Synthetic: BBa_J61110
tctagagaaagaggcgaattactagatg

SEQ ID NO: 1030 - DNA, 28 bp, Artificial Sequence
  Synthetic: BBa_J61111
tctagagaaagaggcgatacactagatg

SEQ ID NO: 1031 - DNA, 28 bp, Artificial Sequence
  Synthetic: BBa_J61112
tctagagaaagaggtgacatactagatg

SEQ ID NO: 1032 - DNA, 28 bp, Artificial Sequence
  Synthetic: BBa_J61113
tctagagaaagagtggaaaaactagatg

SEQ ID NO: 1033 - DNA, 28 bp, Artificial Sequence
  Synthetic: BBa_J61114
tctagagaaagatgagaagaactagatg

SEQ ID NO: 1034 - DNA, 28 bp, Artificial Sequence
  Synthetic: BBa_J61115
tctagagaaagaagggatacactagatg

SEQ ID NO: 1035 - DNA, 28 bp, Artificial Sequence
  Synthetic: BBa_J61116
tctagagaaagacatgaggcactagatg

SEQ ID NO: 1036 - DNA, 28 bp, Artificial Sequence
  Synthetic: BBa_J61117
tctagagaaagacatgagttactagatg

SEQ ID NO: 1037 - DNA, 28 bp, Artificial Sequence
  Synthetic: BBa_J61118
tctagagaaagagacgaatcactagatg

SEQ ID NO: 1038 - DNA, 28 bp, Artificial Sequence
  Synthetic: BBa_J61119
tctagagaaagatttgatatactagatg

SEQ ID NO: 1039 - DNA, 28 bp, Artificial Sequence
  Synthetic: BBa_J61120
tctagagaaagacgcgagaaactagatg

SEQ ID NO: 1040 - DNA, 28 bp, Artificial Sequence
  Synthetic: BBa_J61121
tctagagaaagagacgagtcactagatg

SEQ ID NO: 1041 - DNA, 28 bp, Artificial Sequence
  Synthetic: BBa_J61122
tctagagaaagagaggagccactagatg

SEQ ID NO: 1042 - DNA, 28 bp, Artificial Sequence
  Synthetic: BBa_J61123
tctagagaaagagatgactaactagatg

SEQ ID NO: 1043 - DNA, 28 bp, Artificial Sequence
  Synthetic: BBa_J61124
tctagagaaagagccgacatactagatg

SEQ ID NO: 1044 - DNA, 28 bp, Artificial Sequence
  Synthetic: BBa_J61125
tctagagaaagagccgagttactagatg

SEQ ID NO: 1045 - DNA, 28 bp, Artificial Sequence
  Synthetic: BBa_J61126
tctagagaaagaggtgactcactagatg

SEQ ID NO: 1046 - DNA, 28 bp, Artificial Sequence
  Synthetic: BBa_J61127
tctagagaaagagtggaactactagatg

SEQ ID NO: 1047 - DNA, 28 bp, Artificial Sequence
  Synthetic: BBa_J61128
tctagagaaagataggactcactagatg

SEQ ID NO: 1048 - DNA, 28 bp, Artificial Sequence
  Synthetic: BBa_J61129
tctagagaaagattggacgtactagatg

SEQ ID NO: 1049 - DNA, 28 bp, Artificial Sequence
  Synthetic: BBa_J61130
tctagagaaagaaacgacatactagatg

SEQ ID NO: 1050 - DNA, 28 bp, Artificial Sequence
  Synthetic: BBa_J61131
tctagagaaagaaccgaattactagatg

SEQ ID NO: 1051 - protein, 26 aa, Artificial Sequence
  Synthetic: polypeptide linker
SSADDAKKDAAKKDDAKKDDAKKDAS

SEQ ID NO: 1052 - protein, 15 aa, Artificial Sequence
  Synthetic: polypeptide linker
GGGGSGGGGSGGGGS

The invention claimed is:

1. A genetically engineered non-pathogenic microorganism for intratumoral administration comprising a gene sequence for producing kynureninase, wherein the gene sequence is operably linked to an inducible promoter, and wherein the bacterium further comprises an aroP, tnaB, or mtr gene sequence encoding a transporter for importing kynurenine into the bacterium; and wherein the bacterium is an auxotroph comprising a deletion in a thyA, dapD, or dapA gene.

2. The genetically engineered bacterium of claim 1,
i) wherein the bacterium is a Gram-negative bacterium or a Gram-positive bacterium;
ii) wherein the bacterium is an obligate anaerobic bacterium, or a facultative anaerobic bacterium, or an aerobic bacterium;
iii) wherein the bacterium is a tumor-targeting bacterium; and/or
iv) wherein the bacterium is selected from E. coli Nissle, Clostridium novyi NT, Clostridium butyricum, and E. coli K-12.

3. The genetically engineered bacterium of claim 1,
wherein the inducible promoter is induced by low-oxygen or anaerobic conditions,
wherein the inducible promoter is induced by the hypoxic environment of a tumor;
wherein the inducible promoter is a temperature sensitive promoter; and/or
wherein the inducible promoter is selected from a FNR-inducible promoter, an ANR-inducible promoter, a DNR-inducible promoter.

4. The genetically engineered bacterium of claim 1, wherein the bacterium comprises a kill switch.

5. A pharmaceutically acceptable composition comprising the bacterium of claim 1 and a pharmaceutically acceptable carrier, wherein the composition is formulated for intratumoral administration.

6. A method of treating or modulating cancer in a subject in need thereof comprising the step of administering to the subject the composition of claim 1.

7. The method of claim 6, further comprising administering to the subject a checkpoint inhibitor.

* * * * *

UNITED STATES PATENT AND TRADEMARK OFFICE
CERTIFICATE OF CORRECTION

PATENT NO. : 11,723,932 B2
APPLICATION NO. : 16/069220
DATED : August 15, 2023
INVENTOR(S) : Falb et al.

Page 1 of 1

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 1402 days.

Signed and Sealed this
Nineteenth Day of August, 2025

Coke Morgan Stewart
*Acting Director of the United States Patent and Trademark Office*